(12) United States Patent
Turner et al.

(10) Patent No.: US 9,506,072 B2
(45) Date of Patent: Nov. 29, 2016

(54) REGULATED GENE EXPRESSION SYSTEMS AND CONSTRUCTS THEREOF

(75) Inventors: Robert J. Turner, Aurora, IL (US); Valerie Sershon, Niles, IL (US); John Aikens, La Grange, IL (US); Denise Holzle, Bolingbrook, IL (US)

(73) Assignee: Proterro, Inc., Bronxville, NY (US)

( * ) Notice: Subject to any disclaimer, the term of this patent is extended or adjusted under 35 U.S.C. 154(b) by 545 days.

(21) Appl. No.: 13/430,381

(22) Filed: Mar. 26, 2012

(65) Prior Publication Data

US 2012/0244622 A1    Sep. 27, 2012

Related U.S. Application Data

(60) Provisional application No. 61/467,873, filed on Mar. 25, 2011.

(51) Int. Cl.
*C12N 15/63* (2006.01)

(52) U.S. Cl.
CPC .................................. *C12N 15/635* (2013.01)

(58) Field of Classification Search
None
See application file for complete search history.

(56) References Cited

U.S. PATENT DOCUMENTS

2010/0151567 A1    6/2010    Franklin et al.
2012/0164701 A1    6/2012    Trimbur et al.

FOREIGN PATENT DOCUMENTS

| CN | 101407824 | 4/2009 |
|---|---|---|
| WO | WO 2009098089 | 8/2009 |
| WO | WO 2012116345 | 8/2012 |

OTHER PUBLICATIONS

Alexeyev et al., Improved antibiotic-resistance gene cassettes and omega elements for *Escherichia coli* vector construction and in vitro deletion/insertion mutagenesis, Gene, 1995, pp. 63-67, vol. 160.
Eaton-Rye, The Construction of Gene Knockouts in the Cyanobacterium *Synechocystis* sp. PCC 6803, 2004, from Methods in Molecular Biology, vol. 274: Photosynthesis Research Protocols, pp. 309-324, Humana Press Inc., Totowa, NJ.
Emlyn-Jones et al., Nitrogen-Regulated Hypermutator Strain of *Synechococcus* sp. For Use in In Vivo Artificial Evolution, Appl Environ Microbiol., 2003, pp. 6427-6433, vol. 69, No. 11.
Herrero et al., Nitrogen Control in Cyanobacteria, J Bacteriol, 2001, pp. 411-425, vol. 183, No. 2.
Horinouchi et al., Nucleotide Sequence and Functional Map of pE194, a Plasmid that Specifies Inducible Resistance to Macrolide, Lincosamide, and Streptogramin Type B Antibotics, J. Bacteriol., 1982, pp. 804-814, vol. 150, No. 2.
Huang et al., Design and characterization of molecular of molecular tools for a Synthetic Biology approach towards developing cyanobacterial biotechnology, Nuc Acid Res, 2010, pp. 2577-2593, vol. 38, No. 8 and Supplementary Materials (4 pages), total of 21 pages.
Imai et al., Changes in the Synthesis of Rubisco in Rice Leaves in Relation to Senescence and N Influx, Ann Botany, 2008, pp. 135-144, vol. 101.
International Search Report and Written Opinion dated Jun. 26, 2012 in corresponding International Application No. PCT/US2012/030602 filed Mar. 26, 2012, 7 pages.
Jiang et al., Evidence for redox regulation of the transcription factor NtcA, acting both as an activator and a repressor, in the cyanobacterium Anabaena PCC 7120, Biochem J, 1997, pp. 513-517, vol. 327.
Kadonaga, The DPE, a core promoter element for transcription by RNA polymerase II, Exp Mol Med, 2002, pp. 259-264, vol. 34, No. 4.
Kamei et al., A eukaryotic-type protein kinase, SpkA, is required for normal motility of the unicellular cyanobacterium *Synechocystis* sp. strain PCC 6803, J Bact., 2001, pp. 1505-1510, vol. 183, No. 5.
Kaneko et al., Complete genomic sequence of the filamentous nitrogen-fixing cyanobacterium *Anabaena* sp. strain PCC 7120, DNA Res, 2001, pp. 205-213, vol. 8.
Kaneko et al., Structural analysis of four large plasmids harboring in a unicellular cyanobacterium, *Synechocystis* sp. PCC 6803, DNA Res., 2003, pp. 221-228, vol. 10.
Laurentin et al., A microtiter modification of the anthrone-sulfuric acid colorimetric assay for glucose-based carbohydrates, Anal. Biochem., 2003, pp. 143-145, vol. 315.
Li et al., The nitrate reductase gene-switch: A system for regulated expression in transformed cells of Dunaliella salina, Gene, 2007, pp. 132-142, vol. 403.
Llacer et al., Structural basis for the regulation of NtcA-dependent transcription by proteins PipX and PII, 2010, PNAS, 2010, pp. 15397-15402, vol. 107, No. 35.
Muro-Pastor et al., Ammonium assimilation in cyanobacteria, Photosynth Res., 2005, pp. 135-150, vol. 83, No. 2.
Nierzwicki-Bauer et al., Cotranscription of genes encoding the small and large subunits of ribulose-1,5-bisphosphate carboxylase in the cyanobacterium Anabaena 7120, Proc Natl Acad Sci USA, 1984, pp. 5961-5965, vol. 81.
Nunes-Nesi et al., Metabolic and Signaling Aspects Underpinning the Regulation of Plant Carbon Nitrogen Interactions, Mol Plant Advance Access, 2010, pp. 1-24.
Panoff et al., Sulphated exopolysaccharides produced by two unicellular strains of cyanobacteria, *Synechocystis* PCC 6803 and 6714, Arch Microbiol., 1988, pp. 558-563, vol. 150.
Panoff et al., Selection by anion-exchange chromatography of exopolysaccharide mutants of the cyanobacterium *Synechocystis* PCC 6803, Appl. Environ. Microbiol., 1989, pp. 1452-1456, vol. 55, No. 6.

(Continued)

*Primary Examiner* — Nancy T Vogel
(74) *Attorney, Agent, or Firm* — Dentons US LLP

(57) ABSTRACT

Compositions and methods for nitrogen sensitive regulation of expression of a transcribable nucleic acid molecule. One aspect provides a nitrogen-sensitive expression system that includes a transcription factor region comprising an NtcA binding site and a core promoter region comprising a RuBisCo promoter or a variant or a functional fragment thereof. Another aspect provides a method of transforming a host cell with an expression system. Also provided are expression cassettes, transformed host cells, and kits.

11 Claims, 4 Drawing Sheets

(56) References Cited

OTHER PUBLICATIONS

Ramasubramanian et al., Two *Anabaena* sp. Strain PCC 7120 DNA-Binding Factors Interact with Vegetative Cell- and Heterocyst-Specific Genes, J Bacteriol, 1994, pp. 1214-1223, vol. 176, No. 5.

Stoker et al., Versatile low-copy-number plasmid vectors for cloning in *Escherichia coli*, Gene, 1982, pp. 335-341, vol. 18.

Su et al., Comparative genomics analysis of NtcA regulations in cyanobacteria: regulation of nitrogen assimilation and its coupling to photosynthesis, Nuc Acids Res, 2005, pp. 5156-5171, vol. 33, No. 16.

Vazquez-Bermudez et al., Analysis of binding sites for the nitrogen-control transcription factor NtcA in the promoters of *Synechococcus* nitrogen-regulated genes, Biochemica et Biophysica Acta, 2002, pp. 95-98, vol. 1578.

Bakhsh, A mini review: rubisco small subunit as a strong, green tissue-specific promoter, Arch. Biol. Sci., Belgrade, 63(2), 2011, pp. 299-307.

CN101407824 Published Apr. 15, 2009, abstract downloaded from Espacenet Mar. 9, 2015 (2 pages).

China Office Action dated Jan. 29, 2015 translated in English in related Application No. 201280016692.8 filed Mar. 26, 2012 (6 pages).

Europe Office Action dated May 27, 2015 in related Application No. 12764327.8 filed Mar. 26, 2012 (9 pages).

Japan Office Action dated Jan. 27, 2016 in related Application No. 2014-502663 filed Mar. 26, 2012 (10 pages).

Ramasubramanian et al., Transcription of the *Anabaena* sp. Stain PCC 7120 ntcA Gene: Multiple Transcripts and NtcA Binding, Journal of Bacteriology, vol. 178, No. 3, Feb. 1996, pp. 922-926.

Wei et al., *Anabaena* sp. Strain PCC 7120 ntcA Gene Required for Growth on Nitrate and Heterocyst Development, Journal of Bacteriology, vol. 176, No. 15, Aug. 1994, pp. 4473-4482.

ered in part apparent and in by reference in its entirety.

REGULATED GENE EXPRESSION SYSTEMS AND CONSTRUCTS THEREOF

CROSS-REFERENCE TO RELATED APPLICATIONS

This application claims priority from U.S. Provisional Application Ser. No. 61/467,873, Mar. 24, 2011, which is incorporated herein by reference in its entirety.

MATERIAL INCORPORATED-BY-REFERENCE

The Sequence Listing, which is a part of the present disclosure, includes a computer readable form comprising nucleotide or amino acid sequences of the present invention. The subject matter of the Sequence Listing is incorporated herein by reference in its entirety.

BACKGROUND OF THE INVENTION

Large scale production of materials by fermentation is often limited by the costs associated with regulating gene expression. Often the strategies employed require expensive sugar derivatives or other small molecules to trigger protein production leading to desired products.

Promoters are nucleic acid molecules which comprise the 5' regulatory elements that play an integral part in the overall expression of genes in living cells. Isolated promoters that function in host cells or organisms are useful for controlling the expression of operably linked transgenes and thereby modifying host organism or cell phenotypes through the methods of genetic engineering.

NtcA is the primary controller of the nitrogen regulon of cyanobacteria, having a DNA-binding sequence (GTAN$_8$TAC). Depending upon placement relative to the promoter and the transcription start position, NtcA binding can either activate or repress transcription (reviewed in Herrero et al. 2001 and Muro-Pastor et al. 2005). NtcA-mediated control of transcription is influenced by the nitrogen to-carbon ratio, with 2-oxoglutarate functioning as the effector molecule. Emlyn-Jones et al. (2003) disclosed the use of the nitrite reductase promoter for mutS expression, allowing control of the mutation frequency of *Synechococcus elongatus* PCC 7942 by varying the nitrogen source.

The ribulose-1,5-bisphosphate carboxylase oxygenase (RuBisCo) promoter from cyanobacteria is thought to be one of the strongest known promoters, since RuBisCo is one of the proteins expressed in highest abundance in the biosphere.

SUMMARY OF THE INVENTION

Among the various aspects of the present disclosure is the provision of a nitrogen-sensitive expression system for the expression of a transcribable nucleic acid molecule in a host cell.

One aspect provides nitrogen-sensitive expression system. In some embodiments, the expression system includes a transcription factor region comprising an NtcA binding site; and a core promoter region comprising a RuBisCo promoter or a variant or a functional fragment thereof. In some embodiments, the core promoter region comprises or is operably linked to the transcription factor region. Some embodiments include a transcribable nucleic acid molecule operably linked to the 3' transcription termination nucleic acid molecule.

Another aspect provides a method for expressing a transcribable nucleic acid molecule in a host cell. In some embodiments, a host cell is stably transformed with an expression system described herein and the host, or progeny having the expression system, is grown under conditions whereby the transcribable nucleic acid molecule is expressed. The expression system can provide for nitrogen-regulated expression of the transcribable nucleic acid molecule in a host cell. In some embodiments, expression of the transcribable nucleic acid molecule is repressed when nitrate is a predominant nitrogen source and the transcribable nucleic acid molecule is expressed when urea or ammonia is the predominant nitrogen source.

Another aspect provides an expression cassette. In some embodiments, the expression cassette includes (a) a transcription factor region comprising an NtcA binding site; (b) a core promoter region comprising a RuBisCo promoter or a variant or a functional fragment thereof; (c) a transcribable nucleic acid molecule; and (d) a 3' transcription termination nucleic acid molecule; wherein, the core promoter region comprises or is operably linked to the transcription factor region; the core promoter region is operably linked to the transcribable nucleic acid molecule; the transcribable nucleic acid molecule is operably linked to the 3' transcription termination nucleic acid molecule; and elements (a)-(d) are positioned in relation to each other such that expression of the expression cassette in a host organism results in production of a polypeptide sequence encoded by the transcribable nucleic acid molecule. In some embodiments, the expression cassette includes a polynucleotide sequence encoding an NtcA polypeptide or an NtcB polypeptide positioned such that expression of the expression cassette in the host organism results in production of the NtcA polypeptide or the NtcB polypeptide.

Another aspect provides a transgenic host cell. In some embodiments, the transgenic host cell, or progeny thereof, includes an expression system described herein. In some embodiments, the transgenic host cell is produced by the method for expressing a transcribable nucleic acid molecule described herein, or the progeny thereof; comprising the expression system. In some embodiments, the transgenic host cell includes the expression cassette described herein.

In some embodiments, the transgenic host cell expresses the polypeptide sequence encoded by the transcribable nucleic acid molecule in the presence of nitrate; and represses expression of the polypeptide sequence encoded by the transcribable nucleic acid molecule in the presence of ammonia.

In some embodiments, the transgenic host cell expresses the polypeptide sequence encoded by the transcribable nucleic acid molecule in the presence of ammonia; and represses expression of the polypeptide sequence encoded by the transcribable nucleic acid molecule in the presence of nitrate.

Another aspect provides a kit including one or more of an expression system or expression cassette described herein and, optionally, instructions for introducing the expression cassette into a host cell.

Other objects and features will be in part apparent and in part pointed out hereinafter.

DESCRIPTION OF THE DRAWINGS

Those of skill in the art will understand that the drawings, described below, are for illustrative purposes only. The drawings are not intended to limit the scope of the present teachings in any way.

DETAILED DESCRIPTION OF THE INVENTION

Figure 1:
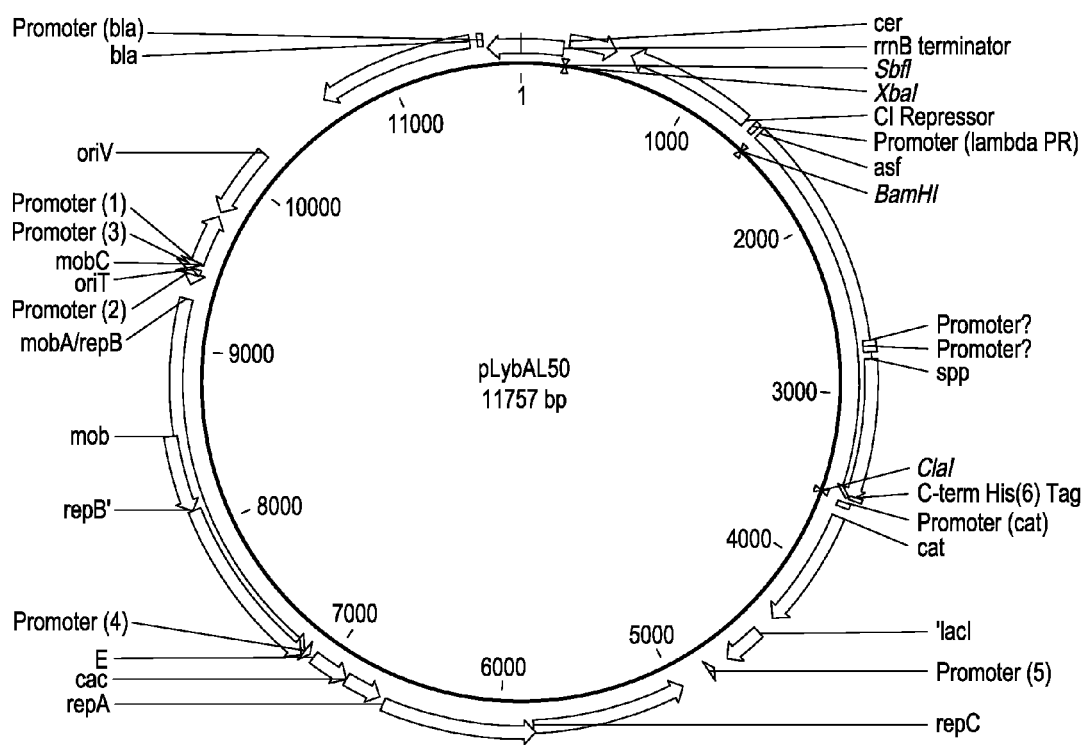
FIG. 1 is a cartoon depicting the structure of plasmid pLybAL50, a derivative of pLybAL19, where the primary differences are that the GTG start codon of asf has been replaced with the more conventional ATG codon and a His6-tag has been appended to the C-terminus of asf. Further details regarding methodology are disclosed in Example 3.
Figure 2:
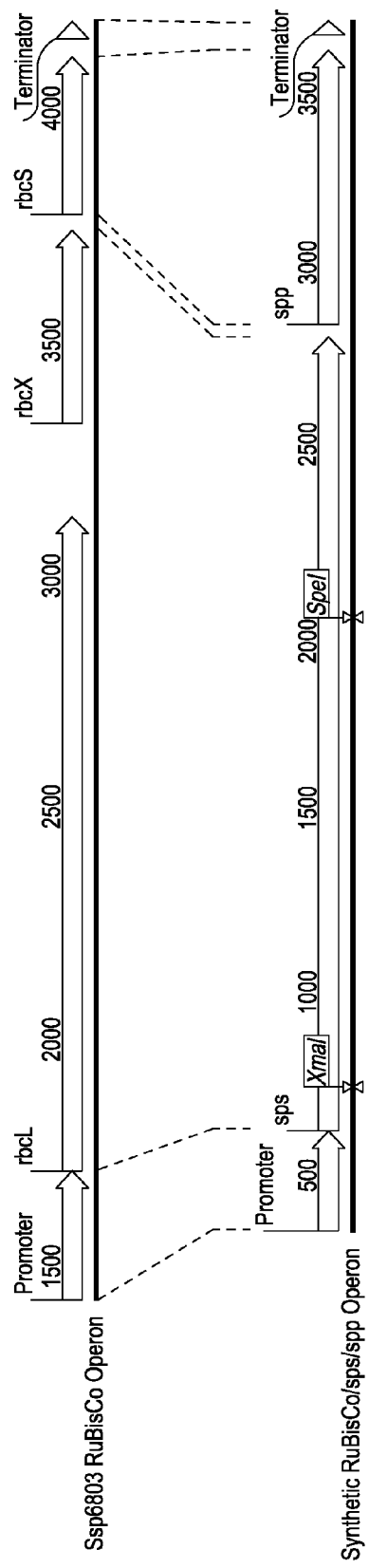
FIG. 2 is a cartoon depicting the "RuBisCo Swap." The top group of arrows shows the *Synechocystis* sp. PCC 6803 RuBisCo operon. The bottom group of arrows shows the synthetic operon comprised of the *Synechocystis* sp. PCC 6803 sps and spp genes, as found in plasmid pLybAL67. The synthetic *Synechocystis* sp. PCC 6803 sps/spp operon should have the same transcriptional and translational initiation and termination signals as the original *Synechocystis* sp. PCC 6803 RuBisCo operon. Plasmid pLybAL66 is the same as pLybAL67, except the XmaI/SpeI fragment of the sps gene is absent. Further details regarding methodology are disclosed in Example 3.

The present disclosure relates to the use of a defined gene regulatory sequence to control the expression of functional genes according to culture media composition.

The present disclosure is based at least in part on the recognition that gene expression under a strong promoter, such as a RuBisCo promoter, may require regulation to provide for adequate or optimal organism growth. The present disclosure is also based at least in part on the recognition that a promoter containing an NtcA binding site (e.g., rbcL) can be used to regulate target gene expression where the target gene is repressed when nitrate is the sole nitrogen source, but expressed when grown with ammonical nitrogen, or other non-nitrate reduced nitrogen sources, such as urea. This system is understood to be an NtcA-repressed system. It is also recognized that the expression systems described herein can be used to regulate target gene expression where the target gene is expressed when nitrate is the sole nitrogen source, but repressed when grown with ammonical nitrogen, or other non-nitrate nitrogen sources, such as urea. This system is understood to be an NtcA-activated system. As reported herein, while a nitrite reductase promoter containing an NtcA binding site can regulate gene expression, the nitrite reductase promoter is relatively weak leading to unacceptably low protein production.

Various embodiments provide compositions and methods that utilize a nitrogen source of a culture medium to control gene regulation and protein expression.

Further provided is modulated gene expression by providing a construct comprising a nitrogen-sensitive transcription factor region and a core promoter region, or variant or functional fragment thereof. Such a construct can afford high levels of protein production in the system at defined points of a cultivation process. Various systems described herein can be applied to production of protein materials including, but not limited to, sugar biosynthetic enzymes or other industrial enzymes, such as ester hydrolases. A system described herein can be applied to produce small molecules (including, but not limited to, sugars) derived from the action corresponding enzymes.

Except as otherwise noted herein, compositions and processes of the present disclosure can be carried out in accordance with compositions and processes described in US App Pub No. 2009/0181434, filed Jan. 5, 2009, incorporated herein by reference in its entirety.

A nitrogen regulated expression system as described herein can be particularly advantageous when used in conjunction with a bioreactor, such as a solid phase bioreactor. When used in conjunction with a bioreactor, on-the-fly modulation of protein expression can be obtained by altering the nitrogen source within the feed. A solid phase bioreactor can be according to that disclosed in US App Pub No. 2009/0181434, filed Jan. 5, 2009, incorporated herein by reference in its entirety.

The following definitions and methods are provided to better define the present invention and to guide those of ordinary skill in the art in the practice of the present invention. Unless otherwise noted, terms are to be understood according to conventional usage by those of ordinary skill in the relevant art.

The terms "heterologous DNA sequence", "exogenous DNA segment" or "heterologous nucleic acid," as used herein, each refer to a sequence that originates from a source foreign to the particular host cell or, if from the same source, is modified from its original form. Thus, a heterologous gene in a host cell includes a gene that is endogenous to the particular host cell but has been modified through, for example, the use of DNA shuffling. The terms also include non-naturally occurring multiple copies of a naturally occurring DNA sequence. Thus, the terms refer to a DNA segment that is foreign or heterologous to the cell, or homologous to the cell but in a position within the host cell nucleic acid in which the element is not ordinarily found. Exogenous DNA segments are expressed to yield exogenous polypeptides. A "homologous" DNA sequence is a DNA sequence that is naturally associated with a host cell into which it is introduced.

Expression vector, expression construct, plasmid, or recombinant DNA construct is generally understood to refer to a nucleic acid that has been generated via human intervention, including by recombinant means or direct chemical synthesis, with a series of specified nucleic acid elements that permit transcription or translation of a particular nucleic acid•in, for example, a host cell. The expression vector can be part of a plasmid, virus, or nucleic acid fragment. Typically, the expression vector can include a nucleic acid to be transcribed operably linked to a promoter.

A "promoter" is generally understood as a nucleic acid control sequence that directs transcription of a nucleic acid. An inducible promoter is generally understood as a promoter that mediates transcription of an operably linked gene in response to a particular stimulus. A promoter can include necessary nucleic acid sequences near the start site of transcription, such as, in the case of a polymerase II type promoter, a TATA element. A promoter can optionally include distal enhancer or repressor elements, which can be located as much as several thousand base pairs from the start site of transcription.

A "transcribable nucleic acid molecule" as used herein refers to any nucleic acid molecule capable of being transcribed into a RNA molecule. Methods are known for introducing constructs into a cell in such a manner that the transcribable nucleic acid molecule is transcribed into a functional mRNA molecule that is translated and therefore expressed as a protein product. Constructs may also be constructed to be capable of expressing antisense RNA molecules, in order to inhibit translation of a specific RNA molecule of interest. For the practice of the present disclosure, conventional compositions and methods for preparing and using constructs and host cells are well known to one skilled in the art (see e.g., Sambrook and Russel (2006) Condensed Protocols from Molecular Cloning: A Laboratory Manual, Cold Spring Harbor Laboratory Press, ISBN-10: 0879697717; Ausubel et al. (2002) Short Protocols in Molecular Biology, 5th ed., Current Protocols, ISBN-10: 0471250929; Sambrook and Russel (2001) Molecular Cloning: A Laboratory Manual, 3d ed., Cold Spring Harbor Laboratory Press, ISBN-10: 0879695773; Elhai, J. and Wolk, C. P. 1988. Methods in Enzymology 167, 747-754).

The "transcription start site" or "initiation site" is the position surrounding the first nucleotide that is part of the transcribed sequence, which is also defined as position +1. With respect to this site all other sequences of the gene and its controlling regions can be numbered. Downstream sequences (i.e., further protein encoding sequences in the 3' direction) can be denominated positive, while upstream sequences (mostly of the controlling regions in the 5' direction) are denominated negative.

"Operably-linked" or "functionally linked" refers preferably to the association of nucleic acid sequences on a single nucleic acid fragment so that the function of one is affected by the other. For example, a regulatory DNA sequence is said to be "operably linked to" or "associated with" a DNA sequence that codes for an RNA or a polypeptide if the two sequences are situated such that the regulatory DNA sequence affects expression of the coding DNA sequence (i.e., that the coding sequence or functional RNA is under the transcriptional control of the promoter). Coding sequences can be operably-linked to regulatory sequences in sense or antisense orientation. The two nucleic acid molecules may be part of a single contiguous nucleic acid molecule and may be adjacent. For example, a promoter is operably linked to a gene of interest if the promoter regulates or mediates transcription of the gene of interest in a cell.

A "construct" is generally understood as any recombinant nucleic acid molecule such as a plasmid, cosmid, virus, autonomously replicating nucleic acid molecule, phage, or linear or circular single-stranded or double-stranded DNA or RNA nucleic acid molecule, derived from any source, capable of genomic integration or autonomous replication, comprising a nucleic acid molecule where one or more nucleic acid molecule has been operably linked.

A constructs of the present disclosure can contain a promoter operably linked to a transcribable nucleic acid molecule operably linked to a 3' transcription termination nucleic acid molecule. In addition, constructs can include but are not limited to additional regulatory nucleic acid molecules from, e.g., the 3'-untranslated region (3' UTR). Constructs can include but are not limited to the 5' untranslated regions (5' UTR) of an mRNA nucleic acid molecule which can play an important role in translation initiation and can also be a genetic component in an expression construct. These additional upstream and downstream regulatory nucleic acid molecules may be derived from a source that is native or heterologous with respect to the other elements present on the promoter construct.

The term "transformation" refers to the transfer of a nucleic acid fragment into the genome of a host cell, resulting in genetically stable inheritance. Host cells containing the transformed nucleic acid fragments are referred to as "transgenic" cells, and organisms comprising transgenic cells are referred to as "transgenic organisms".

"Transformed," "transgenic," and "recombinant" refer to a host cell or organism such as a bacterium, cyanobacterium, animal or a plant into which a heterologous nucleic acid molecule has been introduced. The nucleic acid molecule can be stably integrated into the genome as generally known in the art and disclosed (Sambrook 1989; Innis 1995; Gelfand 1995; Innis & Gelfand 1999). Known methods of PCR include, but are not limited to, methods using paired primers, nested primers, single specific primers, degenerate primers, gene-specific primers, vector-specific primers, partially mismatched primers, and the like. The term "untransformed" refers to normal cells that have not been through the transformation process.

"Wild-type" refers to a virus or organism found in nature without any known mutation.

Expression System Components

One aspect provides an expression regulation system sensitive to a nitrogen source of a media, such as a growth media or fermentation media.

In various embodiments, an expression regulation system includes a transcription factor region and a core promoter region operably linked to a target sequence.

A transcribable nucleic acid molecule sequence can be regulated at the transcriptional level by changing a nitrogen source in the media. For example, mRNA transcription of a transcribable nucleic acid molecule sequence can be switched off in the presence of nitrate or switched on in the presence of a non-nitrate source of reduced nitrogen, such as ammonia or urea. Thus, an expression regulation system described herein can provide controllable expression of a heterologous gene using the inexpensive repressor nitrate and inducer ammonium.

As another example, mRNA transcription of a transcribable nucleic acid molecule sequence can be switched off in the presence of a non-nitrate source of reduced nitrogen, such as ammonia or urea, or switched on in the presence of nitrate. Thus, an expression regulation system described herein can provide controllable expression of a heterologous gene using the inexpensive inducer nitrate and repressor ammonium.

Inclusion of a termination region control sequence is optional, and if employed, then the choice is be primarily one of convenience, as the termination region is relatively interchangeable. The termination region may be native to the transcriptional initiation region (the promoter), may be native to the DNA sequence of interest, or may be obtainable from another source.

A promoter of the present disclosure can be incorporated into a construct using marker genes as described and tested for an indication of gene expression in a stable host system. As used herein the term "marker gene" refers to any transcribable nucleic acid molecule whose expression can be screened for or scored in some way.

Transcription Factor Region

Provided herein is an expression regulation system that can include a nitrogen sensitive transcription factor region. Using an embodiment of a nitrogen regulation system as described herein, a switch from nitrate to ammonical nitrogen (or another non-nitrate reduced form of nitrogen, such as urea) in a culture medium (e.g., a fermentation broth) can result in a loss of repression prohibiting expression of an operably linked gene, thereby effectively turning on protein production at defined times within the cultivation process. In another embodiment, a switch from ammonical nitrogen (or another non-nitrate reduced form of nitrogen, such as urea) to nitrate to in a culture medium can result in a loss of repression prohibiting expression of an operably linked gene, thereby effectively turning on protein production at defined times within the cultivation process.

The present disclosure is based, at least in part, on observations related to NtcA, a primary controller of the nitrogen regulon of cyanobacteria. Results presented herein show that genes operably linked to a nitrite reductase promoter (which contains an NtcA binding site), isolated from *Synechocystis* sp. PCC 6803 and *Synechococcus elongatus* PCC 7942, are expressed when nitrate is the sole nitrogen source, but repressed when grown with ammonical nitrogen (see Example 2). Such a system is consistent with an NtcA activated promoter system (see Hererro 2001 J Bacteriol 183(2) 411-425, 416). These results demonstrate that controlled protein expression, and thus natural product production, can be achieved by alteration of inexpensive sources of nitrogen. While prior reports, such as Emlyn-Jones et al. (2003), have reported use of nitrite reductase promoter for gene regulation, the Inventors have found that while some degree of controlled expression may be achieved, the nitrite reductase promoter in prior systems is relatively weak, which leads to unacceptably low protein production (see Example 2).

The transcription factor region can be operably linked to a core promoter region. The present disclosure is also based, at least in part, on observations from the use of an NtcA binding sequence operably linked to a strong promoter, such as a RuBisCo promoter. Results presented herein show that genes operably linked to a rbcL promoter (which contains an NtcA binding site), or functional fragments thereof, isolated from *Nostoc* sp. PCC 7120 are expressed when ammonia is the sole nitrogen source, but repressed when grown with ammonical nitrogen (see Example 2). Such a system is consistent with an NtcA repressed promoter system (see Hererro 2001 J Bacteriol 183(2) 411-425, 420).

A transcription factor region can have various positions related to a core promoter region. For example, the transcription factor region can be upstream or downstream of a core promoter region. The transcription factor region can be proximate to a core promoter region. The transcription factor region can be distal to a core promoter region. The transcription factor region can be contained within a core promoter region. For example, the transcription factor region can be integrated within the sequence of a core promoter region.

A transcription factor region can comprise a nitrogen sensitive transcription factor. Transcription factors generally can play a role in regulating gene expression in various organisms by activating or repressing expression by, for example, binding to DNA at sites typically upstream of a transcription start site. A transcription factor can exert their function by recruiting polymerases to the coding DNA molecule. A transcription factor, or sequence-specific DNA-binding factor, is generally understood as a protein that binds to specific DNA sequences, thereby controlling the transcription of genetic information from DNA to mRNA. A transcription factor can perform this function alone or with other proteins in a complex by promoting (activator), or blocking (repressor), the recruitment of RNA polymerase which is the enzyme that performs the transcription of genetic information from DNA to RNA to specific genes. One feature of a transcription factor is that they contain one or more DNA-binding domains, which can attach to specific sequences of DNA adjacent to the genes that they regulate.

A nitrogen sensitive expression regulation system can include a promoter, or a functional fragment or variant thereof, associated with a nitrogen metabolism related gene. A nitrogen sensitive expression regulation system can include a promoter, or a functional fragment or variant thereof, of a nitrite reductase gene. For example, a nitrogen sensitive expression regulation system can include a promoter, or a functional fragment or variant thereof, of a nitrite reductase gene from a cyanobacteria. As a further example, a nitrogen sensitive expression regulation system can include an NtcA-regulated nitrite reductase promoter isolated from *Synechocystis* or *Synechococcus*, or a functional fragment or variant thereof. The NtcA binding site in the endogenous nitrite reductase promoter is understood to function as an activator site by way of its distance from the transcription start site (see Herrero 2001 J Bacteriol 183(2) 411-425). As a further example, a nitrogen sensitive expression regulation system can include an NtcB-regulated nitrite reductase promoter.

A nitrogen sensitive expression regulation system can include a promoter, or a functional fragment or variant thereof, of a nitrogen-regulated gene. A nitrogen sensitive expression regulation system can include a promoter, or a functional fragment or variant thereof, of a nitrogen-regulated RuBisCo gene. For example, a nitrogen sensitive expression regulation system can include a promoter comprising one or more of an NtcA binding site or NtcA binding site consensus sequence. As another example, a nitrogen sensitive expression regulation system can include a promoter comprising one or more of an NtcB binding site or NtcB binding site consensus sequence. As another example, a nitrogen sensitive expression regulation system can include a promoter comprising one or more of an NtcA binding site and an NtcB binding site or an NtcA binding site consensus sequence and an NtcB binding site consensus sequence. As a further example, a nitrogen sensitive expression regulation system can include a promoter of a nitrogen-regulated RuBisCo gene from an algae or a cyanobacteria. As a further example, a nitrogen sensitive expression regulation system can include a promoter of a nitrogen-regulated RuBisCo gene from *Nostoc, Synechocystis* or *Synechococcus*, or a functional fragment or variant thereof. The NtcA binding site in the endogenous rbcL promoter from *Nostoc* is understood to function as a repressor site by way of its proximity to the transcription start site (see Herrero 2001 J Bacteriol 183(2) 411-425).

NtcA is understood to be a helix-turn-helix transcriptional regulator that binds to promoters of nitrogen-regulated genes at various binding domains (see Su et al. 2005 Nucleic Acids Research 33(16), 5156-5171; Llacer et al. 2010 Proc Natl Acad Sci USA 107(35), 15397-402). In an endogenous cyanobacterial NtcA regulon, where ammonium is a preferred nitrogen source, expression of genes for the assimilation of other sources of nitrogen is suppressed in an ammonium-replete environment; while in an ammonium-limited environments, genes involved in the uptake and metabolism of alternative sources of nitrogen can be induced through the binding of NtcA to the cis-regulatory elements in the promoter regions of the genes.

A transcription factor region can comprise one or more of an NtcA nitrogen sensitive transcription factor binding site, an NtcB nitrogen sensitive transcription factor binding site, or a variant or functional fragment thereof. A transcription factor region can comprise at least one each of an NtcA nitrogen sensitive transcription factor binding site and an NtcB nitrogen sensitive transcription factor binding site, or a variant or functional fragment thereof. For example, a transcription factor region can comprise the NtcA nitrogen sensitive transcription factor binding site and the NtcB nitrogen sensitive transcription factor binding site present in SEQ ID NO: 279 (which sequence is a NirA promoter operably linked to NtcA and NtcB), or a fragment thereof, or a sequence having at least at least about 70%, 75%, 80%, 85%, 90%, 95%, or 99% sequence identity thereto.

A transcription factor region can comprise a polynucleotide having a sequence that includes an NtcA binding site consensus sequence or an NtcB binding site consensus sequence. A transcription factor region can comprise a polynucleotide having a sequence that includes both an NtcA binding site consensus sequence and an NtcB binding site consensus sequence. A transcription factor region can comprise a polynucleotide having a sequence that includes both an NtcA binding site consensus sequence and an NtcB binding site consensus sequence present in SEQ ID NO: 279 (which sequence is a NirA promoter operably linked to NtcA and NtcB), or a fragment thereof, or a sequence having at least at least about 70%, 75%, 80%, 85%, 90%, 95%, or 99% sequence identity thereto.

An Ntca binding site sequence of a construct described herein can have a sequence the same as or similar (e.g., at least about 70%, 75%, 80%, 85%, 90%, 95%, or 99% sequence identity) to an NtcA binding sequence functionally associated with nitrogen-regulated genes of organisms such as *Nostoc, Synechocystis*, or *Synechococcus*. For example, an NtcA binding site sequence of a construct described herein can have a sequence the same as or similar (e.g., at least about 70%, 75%, 80%, 85%, 90%, 95%, or 99% sequence identity) to an NtcA binding sequence functionally associated with promoter regions of nitrogen-regulated genes (e.g., nitrogen-regulated cyanobacterial genes). Promoter regions for nir operon, nirB-ntcB, ntcA, glnA, glnB, amt1, urt operon, ntcB, hetC, devBCA, icd; rpoD2-V, nrtP, glnN, nifP, petH, nifH, nif ORF1, vnfDG, and nifHDK are understood or predicted to act as NtcA-activated promoters (see Herrero 2001 J Bacteriol 183(2) 411-425, 417, 418). Promoter regions for rbcL, hanA gor, gifA, and gifB are understood or predicted to act as NtcA-repressed promoters (see Herrero 2001 J Bacteriol 183(2) 411-425,). Other promoter regions containing an NtcA binding site include xisA, glbN, and nif H. Any of the above sequences, or a variant or functional fragment thereof containing an NtcA binding site can be included in an expression system described herein.

For example, an NtcA binding site sequence of a construct described herein can have a sequence the same as or similar to an NtcA binding sequence functionally associated with promoter regions of nirA (SEQ ID NO: 26, SEQ ID NO; 32), or sequence having at least about 70%, 75%, 80%, 85%, 90%, 95%, or 99% sequence identity thereto, or a fragement thereof.

For example, an NtcA binding site sequence of a construct described herein can have a sequence the same as or similar (e.g., at least about 70%, 75%, 80%, 85%, 90%, 95%, or 99% sequence identity) to an NtcA binding site in one or more of the following genomes: *Gloeobacter violaceus* PCC 7421(PCC7421); *Nostoc* sp. PCC 7120(PCC7120); *Prochlorococcus marinus* CCMP1375(PCC1375); *Prochlorococcus marinus* MED4(MED4); *Prochlorococcus marinus* MIT9313 (MIT9313); *Synechococcus elongatus* PCC 6301 (PCC6310); *Synechococcus* sp. WH8102(WH8102); *Synechocystis* sp. PCC 6803(PCC6803) and *Thermosynechococcus elongates* BF-1(*thermosynechococcus*). As another example, an NtcA binding site sequence of a construct described herein can have a sequence the same as or similar (e.g., at least about 70%, 75%, 80%, 85%, 90%, 95%, or 99% sequence identity) to an NtcA binding site disclosed in Su et al. 2005 Nucleic Acids Research 33(16), 5156-5171, incorporated herein by reference. As another example, an NtcA binding site sequence of a construct described herein can have a sequence the same as or similar (e.g., at least about 70%, 75%, 80%, 85%, 90%, 95%, or 99% sequence identity) to an NtcA binding site disclosed in Jiang et al. 1997 Biochem J 327, 513-517, incorporated herein by reference.

As another example, an NtcA binding site sequence of a construct described herein can have a sequence the same as or similar (e.g., at least about 70%, 75%, 80%, 85%, 90%, 95%, or 99% sequence identity) to an NtcA binding site contained in a RuBisCo promoter sequence from *Nostoc* sp. PCC 7120. As another example, an NtcA binding site sequence of a construct described herein can have a sequence the same as or similar (e.g., at least about 70%, 75%, 80%, 85%, 90%, 95%, or 99% sequence identity) to an NtcA binding site contained in any of SEQ ID NO: 180, SEQ ID NO: 181, SEQ ID NO: 182, SEQ ID NO: 183 (Nsp7120 rbc Promoter), SEQ ID NO: 227 (Ssp6803 RuBisCo promoter), SEQ ID NO: 231 (Selo7942 RuBisCo promoter), or SEQ ID NO: 234 (Nsp7120 rbc promoter).

As another example, an NtcA binding site sequence of a construct described herein can have a sequence the same as or similar (e.g., at least about 70%, 75%, 80%, 85%, 90%, 95%, or 99% sequence identity) to an NtcA binding site contained in plasmids pLybDB2 (SEQ ID NO: 188), pLybDB3 (SEQ ID NO: 189), pLybDB4 (SEQ ID NO: 190), pLybDB5 (SEQ ID NO: 191), pLybDB6 (SEQ ID NO: 235), pLybDB7 (SEQ ID NO: 236), or pLybDB9 (SEQ ID NO: 237). As another example, an NtcA binding site sequence of a construct described herein can have a sequence the same as or similar (e.g., at least about 70%, 75%, 80%, 85%, 90%, 95%, or 99% sequence identity) to an NtcA binding site contained in plasmid pLybDB4 (SEQ ID NO: 190).

As another example, an NtcA binding site sequence or an NtcB binding site sequence of a construct described herein can have a sequence the same as or similar (e.g., at least about 70%, 75%, 80%, 85%, 90%, 95%, or 99% sequence identity) to an NtcA binding site contained in plasmids pLybAL106 (SEQ ID NO: 272) or pLybAL107 (SEQ ID NO: 273). For example, an NtcA binding site sequence of a construct described herein can have a sequence the same as or similar (e.g., at least about 70%, 75%, 80%, 85%, 90%, 95%, or 99% sequence identity) to an NtcA binding site contained in plasmid pLybAL106 (SEQ ID NO: 272).

A transcription factor region can comprise a polynucleotide having a sequence that includes a $GTAN_{11}C$ consensus sequence, which can be a canonical binding site consensus sequence for NtcA. The GTA triplet is considered to be the most conserved region of this consensus sequence. As a component of the presently described expression system, the NtcA binding site consensus sequence can be positioned such that binding of NtcA effects control of expression of a transcribable nucleic acid molecule. For example, the $GTAN_{11}C$ domain is known to be centered at 39.5 to 40.5 nucleotides upstream of the transcription start site, and can also found in some promoters at upstream positions −109.5 and −180.5. It is understood that such positioning is exemplary and other positions that maintain functionality are contemplated.

A transcription factor region can comprise a polynucleotide having a sequence that includes a $GTAN_8TAC$ consensus sequence. The $GTAN_8TAC$ binding domain is considered a canonical binding site consensus sequence for NtcA.

A transcription factor region can comprise a polynucleotide having a sequence that includes a $GTAN_8TGC$ consensus sequence.

A transcription factor region can comprise a polynucleotide having a sequence that includes a $GTN_{10}AC$ consensus sequence.

A transcription factor region can comprise a polynucleotide having a sequence that includes a $TGTN_9ACA$ consensus sequence. A transcription factor region can comprise a polynucleotide having a sequence that includes a $TGTN_{10}ACA$ consensus sequence.

A transcription factor region can comprise an additional binding domain, such as a −10 like box in the form of $TAN_3T/A$. For example, a transcription factor region can $TAN_3T$ binding domain. As another example, a transcription factor region can $TAN_3A$ binding domain. Such a binding domain can be similar to a −10, $E.\ coli$ $\sigma^{70}$-like box in the form of $TAN_3T$ with an Ntca binding site (which can be as discussed above) replacing the −35 box present in $E.\ coli$ $\sigma^{70}$-type3 promoters (see Su et al. 2005 Nucleic Acids Research 33(16), 5156-5171). In some embodiments, the −10 like box can be present in Ntca-activated promoter constructs (see Herrero 2001 J Bacteriol 183(2) 411-425, 418, 419). A $TAN_3T$ box binding domain can lie, for example, five to six nucleotides upstream from a transcription start site. A $TAN_3T$ box binding domain can lie, for example, 22 or 23 nucleotides upstream from an NtcA binding site consensus sequence. A $TAN_3T$ box binding domain can lie, for example, about 21, about 22, about 23, or about 24 nucleotides upstream from an NtcA binding site consensus sequence (see Herrero 2001 J Bacteriol 183(2) 411-425, 419).

In some embodiments, an NtcA binding site as discussed above can be about 21 to about 24, e.g., 22 or 23, nucleotides downstream of a −10 like box, for example, in constructs where NtcA binding acts as an activator. In some embodiments, an NtcA binding site as discussed above can be near the transcription start site or overlap the −10 like box, for example, in constructs where NtcA binding acts as a repressor.

A transcription factor region can comprise one or more of an NtcA binding site sequence or an NtcA binding site consensus sequence. For example, transcription factor region can comprise at least two, at least three, at least four, at least five, or more, of any NtcA binding site sequence or an NtcA binding site consensus sequence discussed above.

The choice of nitrogen source for inducer and repressor in an embodiment of the expression control system comprising a nitrogen-sensitive transcription factor region can be according to compounds known to function with that transcription factor (see Herrero et al. 2001 J Bacteriol 183(2), 411-425, incorporated herein by reference). For example, in some embodiments, in the presence of nitrate (having a nitrogen oxidation state of +5), expression of transcribable nucleic acid molecule can occur when operably linked to an NtcA activated promoter system; while in the presence of a reduced nitrogen source such as ammonia (having a nitrogen oxidation state of −3), expression from such system is repressed. Conversely, in other embodiments, in the presence of nitrate (having a nitrogen oxidation state of +5), expression of transcribable nucleic acid molecule is repressed when operably linked to an NtcA repressed promoter system; while in the presence of a reduced nitrogen source such as ammonia (having a nitrogen oxidation state of −3), expression from such system is activated. As such, in some embodiments, a nitrogen source having a lower oxidation state than nitrate can have an opposite effect on an NtcA regulated system. In other words, a nitrogen source having a lower oxidation state than nitrate (e.g., ammonia, urea) can act as an expression repressor in an NtcA activated promoter system; and a nitrogen source having a lower oxidation state than nitrate (e.g., ammonia, urea) can act as an expression inducer in an NtcA repressed promoter system.

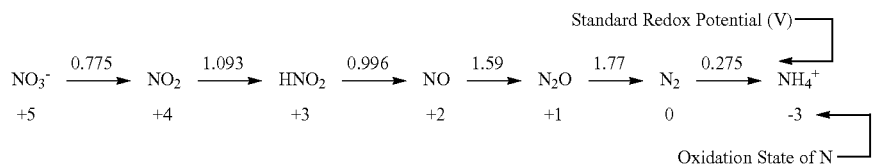

A nitrate can include a salt thereof, such as potassium nitrate or sodium nitrate. A nitrogen compound having a lower oxidation state than nitrate can include, but is not limited to, urea, cyanate, ammonia, ammonium sulfate, amino acids, nitrogen dioxide, nitric oxide, or nitrous oxide. Preferably, a nitrogen compound having a lower oxidation state than nitrate is a soluble nitrogen compound such as ammonia or urea.

Nitrogen Regulon Regulatory Proteins

In some embodiments, addition of excess nitrogen regulon regulatory proteins to the system can further reduce or eliminate expression under non-inducing conditions. As discussed above, an expression regulation system can include a nitrogen sensitive transcription factor region sensitive to nitrogen regulon regulatory proteins (e.g., nitrate inducible nitrogen regulon regulatory proteins). In some embodiments, addition of excess nitrogen regulon regulatory proteins (e.g., NtcA or NtcB) can further reduce or eliminate expression of the target nucleotide sequence under non-inducing conditions (see e.g., Example 9).

A construct described herein can include a nucleotide sequence encoding one or more copies of NtcA or NtcB, or both. For example, a construct described herein can include a nucleotide sequence of SEQ ID NO: 279, or a fragment thereof containing portions encoding NtcA or NtcB or both, or a nucleotide having at least about 70%, 75%, 80%, 85%, 90%, 95%, or 99% sequence identity to SEQ ID NO: 279 and encoding NtcA or NtcB or both, or a fragment thereof. As another example, a construct including a nucleotide containing portions encoding NtcA or NtcB can be pLybAL98 (SEQ ID NO: 265).

A nucleotide sequence encoding one or more copies of NtcA or NtcB can be upstream of a transcription factor region. A nucleotide sequence encoding one or more copies of NtcA or NtcB can be downstream of a transcription factor region.

A nucleotide sequence encoding one or more copies of NtcA or NtcB can be positioned within the construct described herein such that expression of the construct results in expression of NtcA polypeptide or NtcB polypeptide. A nucleotide sequence encoding one or more copies of NtcA or NtcB can be upstream of a core promoter region. A nucleotide sequence encoding one or more copies of NtcA or NtcB can be downstream of a core promoter region. For example, nucleotide sequence encoding one or more copies of NtcA or NtcB can be downstream of a nirA promoter (see e.g., Example 9).

Core Promoter Region

Provided herein is a nitrogen-sensitive expression regulation system that can include a core promoter region. Using an embodiment of a nitrogen regulation system as described herein, a core promoter region (e.g., from a RuBisCo promoter) operably linked to a transcription factor region (e.g., an NtcA binding sequence in an Ntca-repressed configuration) can result in regulated expression of a transcribable nucleic acid molecule, where nitrate in a culture medium (e.g., a fermentation broth) can effectively turn off expression and a non-nitrate reduced nitrogen source, such as ammonical nitrogen or urea, can effectively turn on protein production at defined times within the cultivation process. In other embodiments, In another embodiment, a core promoter region operably linked to a transcription factor region (e.g., an NtcA binding sequence in an NtcA-activated configuration) can result in regulated expression of a transcribable nucleic acid molecule upon a switch from a non-nitrate nitrogen source, such as ammonical nitrogen or urea, to nitrate in a culture medium (e.g., a fermentation broth), thereby effectively turning on protein production at defined times within the cultivation process.

The present disclosure is based, at least in part, on observations from the use of a strong RuBisCo promoter. While prior reports have reported use of a strong RuBisCo promoter, the Inventors have found that a RuBisCo promoter in the absence of a regulon (such as the NtcA regulon) results in uncontrolled expression of a transcribable nucleic acid molecule at the expense of host cell growth and viability. Results presented herein show that genes operably linked to a *Synechocystis* sp. PCC 6803 or *Synechococcus elongatus* PCC 7942 RuBisCo promoter are strongly expressed but the host organism exhibited extremely slow growth and loss of viability over time (see Example 4).

The present disclosure is also based, at least in part, on observations from the use of NtcA and its DNA-binding sequence operably linked to a strong promoter, such as a RuBisCo promoter. Initial experiments with an intact RuBisCo promoter comprising an NtcA binding site results in little to no target gene expression. Results presented herein show that genes operably linked to a (non-truncated) *Nostoc* sp. PCC 7120 RuBisCo promoter afforded little to no target gene expression (see Example 6).

Surprisingly, it has been discovered that upstream or downstream truncation of a RuBisCo promoter comprising an NtcA binding site can result significant nitrogen source regulated target gene expression. Results presented herein show that genes operably linked to a *Nostoc* sp. PCC 7120 RuBisCo promoter with either the leading or trailing regions of the promoter sequence deleted (i.e., upstream or downstream truncation) individually demonstrated significant target gene expression in the presence of ammonia (see Example 6).

Yet, truncation of both upstream and downstream regions of a RuBisCo promoter comprising an NtcA binding site results in little to no target gene expression. Results presented herein show that genes operably linked to a *Nostoc* sp. PCC 7120 RuBisCo promoter missing both flanking regions of sequence (i.e., upstream and downstream truncated) afforded little to no target gene expression (see Example 6).

A core promoter region can be operably linked to a transcription factor region. For example, a core promoter region can be upstream or downstream of a transcription factor region. A core promoter region can comprise a transcription factor region. For example, the transcription factor region can be integrated within the sequence of a core promoter region. Location of the transcription factor region with respect to the core promoter region can influence whether the system is an activated or repressed system in the presence of reduced ammonia, as described further herein. For example, where the transcription factor region is an NtcA binding site that is proximate to a core promoter region, as in the rbcL promoter, the expression system can be an NtcA repressor system, where the presence of a reduced nitrogen source, such as ammonia or urea, can turn on expression of an operably linked transcribable nucleic acid molecule, and the presence of nitrate can turn off expression.

A core promoter region can comprise a RuBisCo promoter sequence, or variant or functional fragment thereof.

A core promoter region can have a sequence the same as or similar (e.g., at least about 70%, 75%, 80%, 85%, 90%, 95%, or 99% sequence identity) to a RuBisCo promoter sequence of organisms such as *Nostoc*, *Synechocystis*, or *Synechococcus*. For example, a core promoter region of a construct described herein can have a sequence the same as or similar (e.g., at least about 70%, 75%, 80%, 85%, 90%, 95%, or 99% sequence identity) to a RuBisCo promoter sequence in one or more of the following genomes: *Gloeobacter violaceus* PCC 7421(PCC7421); *Nostoc* sp. PCC 7120(PCC7120); *Prochlorococcus marinus* CCMP1375 (PCC1375); *Prochlorococcus marinus* MED4(MED4); *Prochlorococcus marinus* MIT9313 (MIT9313); *Synechococcus elongatus* PCC 6301(PCC6310); *Synechococcus* sp. WH8102(WH8102); *Synechocystis* sp. PCC 6803 (PCC6803) and *Thermosynechococcus elongates* BF-1(*thermosynechococcus*).

As another example, a core promoter region of a construct described herein can have a sequence the same as or similar (e.g., at least about 70%, 75%, 80%, 85%, 90%, 95%, or 99% sequence identity) to a RuBisCo (rbcLS) promoter sequence in *Nostoc* sp. PCC 7120. As another example, a core promoter region of a construct described herein can have a sequence the same as or similar (e.g., at least about 70%, 75%, 80%, 85%, 90%, 95%, or 99% sequence identity) to a RuBisCo (rbcLS) promoter sequence in *Synechocystis* sp. PCC 6803. As another example, a core promoter region of a construct described herein can have a sequence the same as or similar (e.g., at least about 70%, 75%, 80%, 85%, 90%, 95%, or 99% sequence identity) to a RuBisCo (rbcLS) promoter sequence in *Synechococcus elongatus* PCC 7942. As another example, a core promoter region of a construct described herein can have a sequence the same as or similar (e.g., at least about 70%, 75%, 80%, 85%, 90%, 95%, or 99% sequence identity) to a RuBisCo (rbcLS) promoter sequence in *Anabaena* PCC 7120. As another example, a core promoter region of a construct described herein can be a variant or functional fragment of a RuBisCo (rbcLS) promoter sequence.

A core promoter region of a construct described herein can have a sequence the same as or similar (e.g., at least about 70%, 75%, 80%, 85%, 90%, 95%, or 99% sequence identity) to a RuBisCo (rbcLS) promoter sequence, or variant or functional fragment thereof. For example, a core promoter region of a construct described herein can have a sequence the same as or similar (e.g., at least about 70%, 75%, 80%, 85%, 90%, 95%, or 99% sequence identity) to a rbc promoter region of *Nostoc* sp. PCC 7120, such as SEQ ID NO. 180, SEQ ID NO. 181, SEQ ID NO. 182, or SEQ ID NO. 183. As another example, a core promoter region of a construct described herein can have a sequence the same as or similar (e.g., at least about 70%, 75%, 80%, 85%, 90%, 95%, or 99% sequence identity) to the Nsp7120 rbc promoter region of SEQ ID NO: 234 as follows:

```
     cctgcaggct ccagccatta gcgaaactga ccaaaggtta atctcagtct tcccttagtt    60
120 gggatttttt aaacatatgg ggattgggga ttgggaaaag gcagggggca gaggataagt
180 agaggaggca ggggaagtaa agaagaatga ctatggacta ttgaccaatg actattggca
240 actgacaact gactcctata cagtcattga tacattttgt aactgattgt taacaaaacg
300 tttaaaactt tatgtaataa caaatttaaa tatgtaagtt aagaactttc aaagaataac
360 ttatgccatt tcttgatata ttgtgagaca agttacaaat tacgtggtgt gcaattttt
420 catcttgcgc tgattactct actaaatatc cgtcaagtaa attggctctt agctcgtctc
480 ctgtcaataa aggaggtcgg caagagtgca gaagcgggaa tgtgtgaaaa ctaacccaat
540 tcattaaata ccccgaaata taggggaatc atctcatact ttccgtaaac cgcgaaggtc
600 gtgaagggat aaaagcaatt tagtgggtga gaagaacaga taaaaaagaa ttttttaact
660 atggcaagag gaaaaagtaa aagcgttaac ttatgcactc ctagatgagc aagacactgg
720 tgaagaggat taccactaaa gctaagtgtt agttgcagaa aggtcgctga cctctaccaa
780 aagattattc ctgtttttct cctggctgat agggaggtag ggcaattgtg agaggaaatt
     gtaccaaaac gtgatttgat aagtaaaaag agtgacatct tggaaggatc catatg      836
```

For example, core promoter region of a construct described can have at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, and at least about 99% sequence identity to any one of SEQ ID NO: 234, SEQ ID NO. 180, SEQ ID NO. 181, SEQ ID NO. 182, or SEQ ID NO. 183.

A core promoter region of a construct described herein can have a sequence the same as or similar (e.g., at least about 70%, 75%, 80%, 85%, 90%, 95%, or 99% sequence identity) to a core promoter region contained in plasmids pLybDB2 (SEQ ID NO: 188), pLybDB3 (SEQ ID NO: 189), pLybDB4 (SEQ ID NO: 190), pLybDB5 (SEQ ID NO: 191), pLybDB6 (SEQ ID NO: 235), pLybDB7 (SEQ ID NO: 236), or pLybDB9 (SEQ ID NO: 237).

A core promoter region of a construct described herein can be a functional fragment of any promoter sequence discussed herein. For example, a core promoter region of a construct described herein can be a functional fragment of RuBisCo (e.g., rbcLS) promoter sequence. A functional fragment of a RuBisCo promoter sequence can be a nucleic acid sequence having at least about 50, at least about 75, at least about 95, at least about 100, at least about 125, at least about 150, at least about 175, at least about 200, at least about 250, at least about 300, at least about 350, at least about 400, at least about 450, at least about 500, at least about 550, at least about 600, at least about 650, at least about 700, at least about 750, or at least about 800 contiguous bases of RuBisCo promoter sequence (e.g., rbcLS promoter from *Nostoc* sp. PCC 7120) that retain promoter activity.

A core promoter region of a construct described herein can be a truncated form of a RuBisCo (e.g., rbcLS) promoter sequence. For example, a core promoter region of a construct described herein can be a truncated form of a nitrogen regulated RuBisCo promoter sequence from *Nostoc* sp. PCC 7120.

Figure 3A:
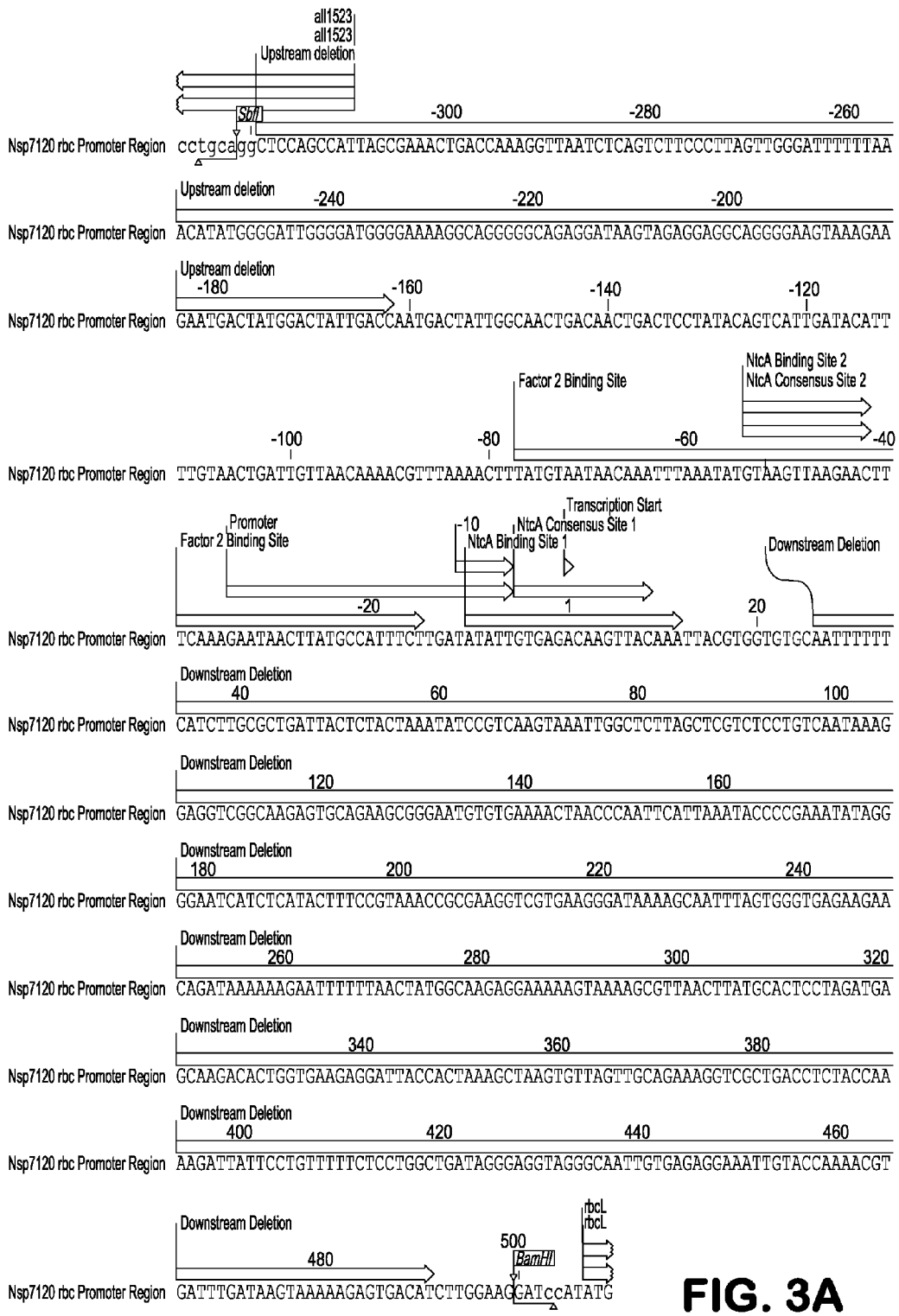
FIG. 3A is a graphical and polynucleotide sequence depiction of the *Nostoc* sp. PCC 7120 promoter. The sequence covers the region between the rbcLXS (which begins 3 bp after the BamHI site) and all1523 (which is transcribed in the direction opposite that of the rbcLXS operon) and is shown in capital letters. Numbering is relative to the transcription start site. The nucleotides upstream and downstream from the core (which contains the promoter, transcription start, and the NtcA and Factor 2 binding sites) that have been deleted from the various constructs are highlighted. The constructs in which the region downstream of the core has been deleted leave the ribosome binding site intact. Further details regarding methodology are disclosed in Example 4.
Figure 3B:
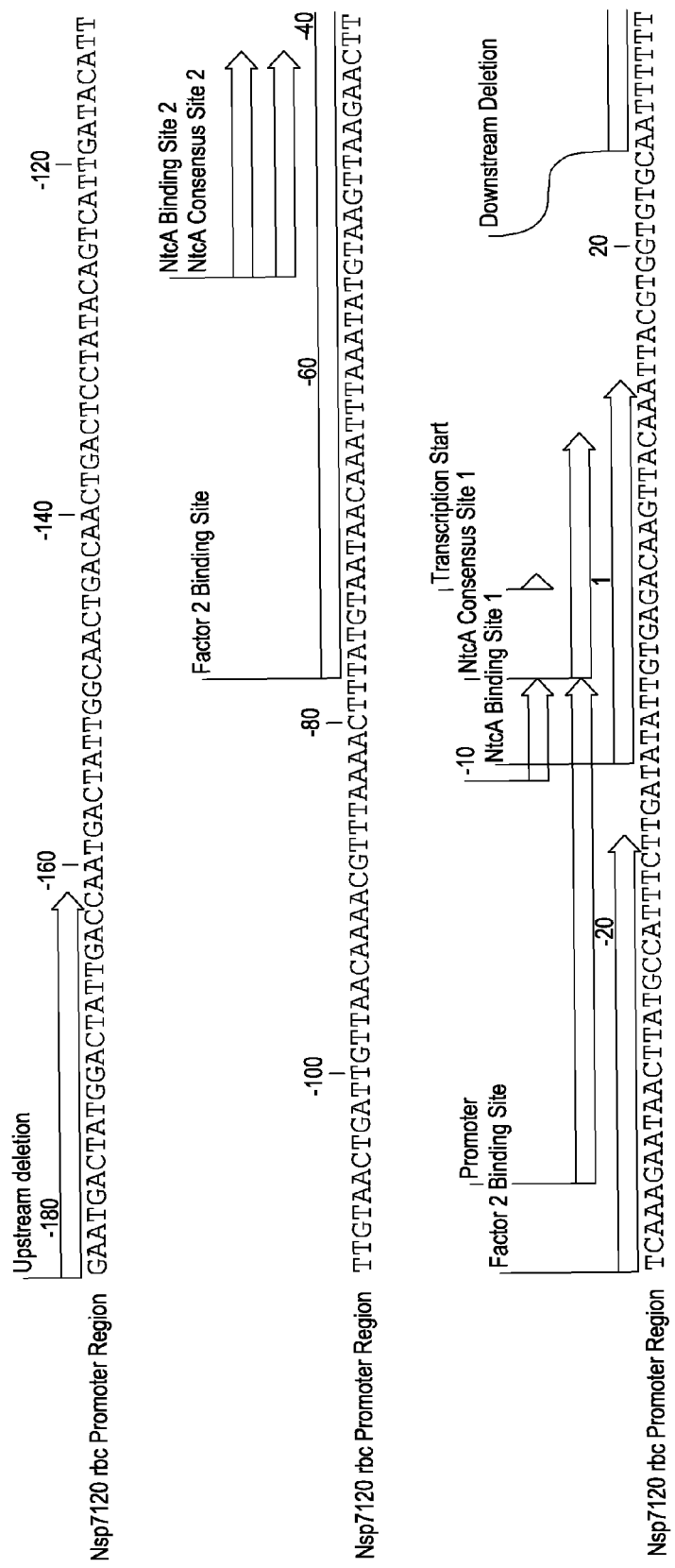
FIG. 3B shows a blown up portion of FIG. 3A.

Truncation of a RuBisCo promoter sequence can be an upstream truncation. For example, a RuBisCo promoter sequence from *Nostoc* sp. PCC 7120 can be upstream truncated from position −319 to −162 (numbering relative to the transcription start site, see FIG. 3) (see Example 6, Example 7). The −162 position of *Nostoc* sp. PCC 7120 as depicted in FIG. 3 corresponds to position 166 of SEQ ID NO: 234. Upstream truncation of a RuBisCo promoter sequence from *Nostoc* sp. PCC 7120 can occur through about position −300 (corresponding to position 28 of SEQ ID NO: 234), about position −250 (corresponding to position 78 of SEQ ID NO: 234), about position −200 (corresponding to position 128 of SEQ ID NO: 234), about position −190 (corresponding to position 138 of SEQ ID NO: 234), about position −180 (corresponding to position 148 of SEQ ID NO: 234), about position −170 (corresponding to position 158 of SEQ ID NO: 234), about position −160 (corresponding to position 168 of SEQ ID NO: 234), about position −150 (corresponding to position 178 of SEQ ID NO: 234), about position −140 (corresponding to position 188 of SEQ ID NO: 234), about position −130 (corresponding to position 198 of SEQ ID NO: 234), about position −120 (corresponding to position 208 of SEQ ID NO: 234), about position −110 (corresponding to position 218 of SEQ ID NO: 234), about position −100 (corresponding to position 228 of SEQ ID NO: 234), about position −90 (corresponding to position 238 of SEQ ID NO: 234), or about position −80 (corresponding to position 248 of SEQ ID NO: 234).

Truncation of a RuBisCo promoter sequence can be an downstream truncation. For example, a RuBisCo promoter sequence from *Nostoc* sp. PCC 7120 can be downstream truncated from position +26 to +491 (numbering relative to the transcription start site, see FIG. 3) (see Example 6, Example 7). The +26 position of *Nostoc* sp. PCC 7120 as depicted in FIG. 3 corresponds to position 353 of SEQ ID NO:234. Downstream truncation of a RuBisCo promoter sequence from *Nostoc* sp. PCC 7120 can occur at about position +10 (corresponding to position 337 of SEQ ID NO: 234), about position +20 (corresponding to position 347 of SEQ ID NO: 234), about position +30 (corresponding to position 357 of SEQ ID NO: 234), about position +40 (corresponding to position 367 of SEQ ID NO: 234), about position +50 (corresponding to position 377 of SEQ ID NO: 234), about position +60 (corresponding to position 387 of SEQ ID NO: 234), about position +70 (corresponding to position of 397 SEQ ID NO: 234), about position +80 (corresponding to position 407 of SEQ ID NO: 234), about position +90 (corresponding to position 417 of SEQ ID NO: 234), about position +100 (corresponding to position 427 of SEQ ID NO: 234), about position +150 (corresponding to position 477 of SEQ ID NO: 234), about position +200 (corresponding to position 527 of SEQ ID NO: 234), about position +250 (corresponding to position 577 of SEQ ID NO: 234), about position +300 (corresponding to position 627 of SEQ ID NO: 234), about position +350 (corresponding to position 677 of SEQ ID NO: 234), about position +400 (corresponding to position 727 of SEQ ID NO: 234), about position +450 (corresponding to position 777 of SEQ ID NO: 234), about position +480 (corresponding to position 807 of SEQ ID NO: 234), or about position +490 (corresponding to position 817 of SEQ ID NO: 234). Downstream truncation of a RuBisCo promoter sequence from *Nostoc* sp. PCC 7120 can occur through, for example, a restriction site present at or near the first codon of rbcL (e.g., BamHI restriction site at position +499).

Transcribable Nucleic Acid Molecule

As described herein, a target nucleotide sequence, such as a transcribable nucleic acid molecule, can be operably linked to an expression regulation system sensitive to one or more components of a media, such as a growth media or fermentation media. For example, a transcribable nucleic acid molecule can be operably linked to an expression regulation system sensitive to nitrogen source present in the media.

Exemplary transcribable nucleic acid molecules for incorporation into constructs of the present disclosure include, for example, nucleic acid molecules or genes from a species other than a host species, or even genes that originate with or are present in the same species, but are incorporated into recipient cells by genetic engineering methods rather than classical reproduction or breeding techniques. Exogenous gene or genetic element is intended to refer to any gene or nucleic acid molecule that is introduced into a recipient cell. The type of nucleic acid molecule included in the exogenous nucleic acid molecule can include a nucleic acid molecule that is already present in the host cell, a nucleic acid molecule from another organism, a nucleic acid molecule from a different organism, or a nucleic acid molecule generated externally, such as a nucleic acid molecule containing an antisense message of a gene, or a nucleic acid molecule encoding an artificial or modified version of a gene.

A transcribable nucleic acid molecule can be any sequence encoding a polypeptide of interest. For example, a transcribable nucleic acid molecule can be a gene encoding a polypeptide having a particular activity of interest.

A transcribable nucleic acid molecule can encode a polypeptide having a sucrose biosynthetic activity. A transcribable nucleic acid molecule can encode a polypeptide having sucrose phosphate synthase activity. A transcribable nucleic acid molecule can encode a polypeptide having sucrose phosphate phosphatase activity. A transcribable nucleic acid molecule can encode a polypeptide having sucrose phosphate synthase activity and sucrose phosphate phosphatase activity.

A transcribable nucleic acid molecule can be an active sps/spp fusion (asf) gene from *Synechococcus elongatus* PCC 7942 that produces an asf gene product, ASF, which has both SPS and SPP biosynthetic functions (see e.g., US App Pub No. 2009/0181434, Example 5). In some embodiments, a target ASF-encoding nucleotide sequence is cloned from its native source (e.g., *Synechococcus elongatus* PCC 7942). In some embodiments, a transcribable nucleic acid molecule comprises an asf polynucleotide of SEQ ID NO: 1. In some embodiments, a transcribable nucleic acid molecule comprises a nucleotide sequence encoding ASF polypeptide of SEQ ID NO: 2. In further embodiments, a transcribable nucleic acid molecule comprises a nucleotide sequence having at least about 80% sequence identity to SEQ ID NO: 1 or a nucleotide sequence encoding a polypeptide having sps and spp activity and at least about 80% sequence identity to SEQ ID NO: 2. As an example, a transcribable nucleic acid molecule can comprise a nucleotide sequence having at least about 85%, at least about 90%, at least about 95%, or at least about 99% sequence identity to SEQ ID NO: 1, wherein the expressed sequence exhibits ASF, SPS, or SPP activity. As an example, a transcribable nucleic acid molecule can comprise a nucleotide sequence encoding a polypeptide having at least about 85%, at least about 90%, at least about 95%, or at least about 99% sequence identity to SEQ ID NO: 2, wherein the expressed sequence exhibits ASF, SPS, or SPP activity. As another example, a transcribable nucleic acid molecule can comprise a nucleotide sequence that hybridizes under stringent conditions to SEQ ID NO: 1 over the entire length of SEQ ID NO: 1, and which encodes an active SPS/SPP fusion (ASF) polypeptide. As a further example, a transcribable nucleic acid molecule can comprise the complement to any of the above sequences.

In some embodiments, a transcribable nucleic acid molecule comprises a sucrose phosphate synthase (sps) (see e.g., SEQ ID NO: 3 encoding sps gene and SEQ ID NO: 4 encoding SPS polypeptide), or homologue thereof. For example, a transcribable nucleic acid molecule can comprise a nucleotide having a sequence of SEQ ID NO: 3 so as to express sucrose phosphate synthase. As another example, a transcribable nucleic acid molecule can comprise a nucleotide having at least about 80%, at least about 85%, at least about 90%, at least about 95%, or at least about 99% percent identity to SEQ ID NO: 3 encoding a polypeptide having sucrose phosphate synthase. As another example, a transcribable nucleic acid molecule can comprise a nucleotide sequence encoding a polypeptide having at least about 85%, at least about 90%, at least about 95%, or at least about 99% sequence identity to SEQ ID NO: 4, wherein the expressed sequence exhibits SPS activity.

In some embodiments, a transcribable nucleic acid molecule comprises a sucrose phosphate phosphatase (spp) (see e.g., SEQ ID NO: 5 encoding spp gene and SEQ ID NO: 6 encoding SPP polypeptide), or homologue thereof. For example, a transcribable nucleic acid molecule can comprise a nucleotide having a sequence of SEQ ID NO: 5 so as to express sucrose phosphate phosphatase. As another example, a transcribable nucleic acid molecule can comprise a nucleotide having at least about 80%, at least about 85%, at least about 90%, at least about 95%, or at least about 99% percent identity to SEQ ID NO: 5 encoding a polypeptide having sucrose phosphate phosphatase activity. As another example, a transcribable nucleic acid molecule can comprise a nucleotide sequence encoding a polypeptide having at least about 85%, at least about 90%, at least about 95%, or at least about 99% sequence identity to SEQ ID NO: 6, wherein the expressed sequence exhibits SPP activity.

In some embodiments, a transcribable nucleic acid molecule can comprise one or more of asf, sps., or spp. For example, a transcribable nucleic acid molecule can comprise asf and sps; asf and spp; sps and spp; or asf, sps, and spp.

A transcribable nucleic acid molecule can encode a polypeptide having trehalose phosphate synthase activity or trehalose phosphate phosphatase activity; gluocosylglycerol phosphate synthase activity or gluocosylglycerol phosphate phosphatase activity; or mannosylfructose phosphate synthase activity or mannosylfructose phosphate phosphatase activity.

In some embodiments, a transcribable nucleic acid molecule comprises a trehalose phosphate synthase (tps) (see e.g., SEQ ID NO: 76 encoding tps gene and SEQ ID NO: 77 encoding TPS polypeptide), or homologue thereof. For example, a transcribable nucleic acid molecule can comprise a nucleotide having a sequence of SEQ ID NO: 76 so as to express trehalose phosphate synthase. As another example, a transcribable nucleic acid molecule can comprise a nucleotide having at least about 80%, at least about 85%, at least about 90%, at least about 95%, or at least about 99% percent identity to SEQ ID NO: 76 encoding a polypeptide having trehalose phosphate synthase. As another example, a transcribable nucleic acid molecule can comprise a nucleotide sequence encoding a polypeptide having at least about 85%, at least about 90%, at least about 95%, or at least about 99% sequence identity to SEQ ID NO: 77, wherein the expressed sequence exhibits TPS activity.

In some embodiments, a transcribable nucleic acid molecule comprises a trehalose phosphate phosphatase (tpp) (see e.g., SEQ ID NO: 78 encoding tpp gene and SEQ ID NO: 79 encoding TPP polypeptide), or homologue thereof. For example, a transcribable nucleic acid molecule can comprise a nucleotide having a sequence of SEQ ID NO: 78 so as to express trehalose phosphate phosphatase. As another example, a transcribable nucleic acid molecule can comprise a nucleotide having at least about 80%, at least about 85%, at least about 90%, at least about 95%, or at least about 99% percent identity to SEQ ID NO: 78 encoding a polypeptide having trehalose phosphate phosphatase activity. As another example, a transcribable nucleic acid molecule can comprise a nucleotide sequence encoding a polypeptide having at least about 85%, at least about 90%, at least about 95%, or at least about 99% sequence identity to SEQ ID NO: 79, wherein the expressed sequence exhibits TPP activity.

In some embodiments, a transcribable nucleic acid molecule comprises a glucosylglycerolphosphate synthase (gps) (see e.g., SEQ ID NO: 80 encoding gps gene and SEQ ID NO: 81 encoding GPS polypeptide), or homologue thereof. For example, a transcribable nucleic acid molecule can comprise a nucleotide having a sequence of SEQ ID NO: 80 so as to express glucosylglycerolphosphate synthase. As another example, a transcribable nucleic acid molecule can comprise a nucleotide having at least about 80%, at least about 85%, at least about 90%, at least about 95%, or at least about 99% percent identity to SEQ ID NO: 80 encoding a polypeptide having glucosylglycerolphosphate synthase. As another example, a transcribable nucleic acid molecule can comprise a nucleotide sequence encoding a polypeptide having at least about 85%, at least about 90%, at least about 95%, or at least about 99% sequence identity to SEQ ID NO: 81, wherein the expressed sequence exhibits GPS activity.

In some embodiments, a transcribable nucleic acid molecule comprises a glucosylglycerolphosphate phosphatase (gpp) (see e.g., SEQ ID NO: 82 encoding gpp gene and SEQ ID NO: 83 encoding GPP polypeptide), or homologue thereof. For example, a transcribable nucleic acid molecule can comprise a nucleotide having a sequence of SEQ ID NO: 82 so as to express glucosylglycerolphosphate phosphatase. As another example, a transcribable nucleic acid molecule can comprise a nucleotide having at least about 80%, at least about 85%, at least about 90%, at least about 95%, or at least about 99% percent identity to SEQ ID NO: 82 encoding a polypeptide having glucosylglycerolphosphate phosphatase activity. As another example, a transcribable nucleic acid molecule can comprise a nucleotide sequence encoding a polypeptide having at least about 85%, at least about 90%, at least about 95%, or at least about 99% sequence identity to SEQ ID NO: 83, wherein the expressed sequence exhibits GPP activity.

In some embodiments, a transcribable nucleic acid molecule comprises a mannosylfructose phosphate synthase (mps) (see e.g., SEQ ID NO: 84 encoding mps gene and SEQ ID NO: 85 encoding MPS polypeptide), or homologue thereof. For example, a transcribable nucleic acid molecule can comprise a nucleotide having a sequence of SEQ ID NO: 84 so as to express mannosylfructose phosphate synthase. As another example, a transcribable nucleic acid molecule can comprise a nucleotide having at least about 80%, at least about 85%, at least about 90%, at least about 95%, or at least about 99% percent identity to SEQ ID NO: 84 encoding a polypeptide having mannosylfructose phosphate synthase. As another example, a transcribable nucleic acid molecule can comprise a nucleotide sequence encoding a polypeptide having at least about 85%, at least about 90%, at least about 95%, or at least about 99% sequence identity to SEQ ID NO: 85, wherein the expressed sequence exhibits MPS activity.

In some embodiments, a transcribable nucleic acid molecule comprises a mannosylfructose phosphate phosphatase (mpp) (see e.g., SEQ ID NO: 86 encoding mpp gene and SEQ ID NO: 87 encoding MPP polypeptide), or homologue thereof. For example, a transcribable nucleic acid molecule can comprise a nucleotide having a sequence of SEQ ID NO: 86 so as to express mannosylfructose phosphate phosphatase. As another example, a transcribable nucleic acid molecule can comprise a nucleotide having at least about 80%, at least about 85%, at least about 90%, at least about 95%, or at least about 99% percent identity to SEQ ID NO: 86 encoding a polypeptide having mannosylfructose phosphate phosphatase activity. As another example, a transcribable nucleic acid molecule can comprise a nucleotide sequence encoding a polypeptide having at least about 85%, at least about 90%, at least about 95%, or at least about 99% sequence identity to SEQ ID NO: 87, wherein the expressed sequence exhibits MPP activity.

Alternatively, a transcribable nucleic acid molecule can effect a host cell or organism phenotype by encoding a RNA molecule that causes the targeted inhibition of expression of an endogenous gene, for example via antisense, inhibitory RNA (RNAi), or co-suppression-mediated mechanisms. The RNA could also be a catalytic RNA molecule (i.e., a ribozyme) engineered to cleave a desired endogenous mRNA product. Thus, any nucleic acid molecule that encodes a protein or mRNA that expresses a phenotype or morphology change of interest may be useful for the practice of the present disclosure.

Hosts

A host organism or a host cell can be transformed with a construct including a transcribable nucleic acid molecule operably linked to an expression regulation system sensitive to one or more media components. For example, a host organism or a host cell can be transformed with a construct including a transcribable nucleic acid molecule operably linked to an expression regulation system sensitive to nitrogen source present in the media.

A construct described herein can be plasmid based or intergrated into the host genome. For example, a construct described herein (e.g., plasmid pLybDB4, SEQ ID NO: 190) can be present in the host as a plasmid (see e.g., Example 11). As another example, a construct described herein (e.g., plasmid pLybAL98, SEQ ID NO: 265) can be integrated into the genome of the host (e.g., strain LYB511) (see e.g., Example 9, Example 11, Example 12). In some embodiments, integration into the genome of the host can increase inducible expression of the target nucleotide (compare Example 11 and Example 12).

A transformed host organism or a host cell can be analyzed for the presence of a gene of interest and the expression level or profile conferred by the expression system of the present disclosure. Those of skill in the art are aware of the numerous methods available for the analysis of transformed hosts. For example, methods for host analysis include, but are not limited to Southern blots or northern blots, PCR-based approaches, biochemical analyses, phenotypic screening methods, and immunodiagnostic assays.

A host organism can be a eukaryotic or a prokaryotic organism.

A host organism can be a photosynthetic microorganism. A host organism can be, for example, a naturally photosynthetic microorganism, such as a cyanobacterium, or an engineered photosynthetic microorganism, such as an artificially photosynthetic bacterium. Exemplary microorganisms that are either naturally photosynthetic or can be engineered to be photosynthetic include, but are not limited to, bacteria; fungi; archaea; protists; microscopic plants, such as a green algae; and animals such as plankton, planarian, and amoeba. Examples of naturally occurring photosynthetic microorganisms include, but are not limited to, *Spirulina maximum, Spirulina platensis, Dunaliella salina, Botrycoccus braunii, Chlorella vulgaris, Chlorella pyrenoidosa, Serenastrum capricornutum, Scenedesmus auadricauda, Porphyridium cruentum, Scenedesmus acutus, Dunaliella* sp., *Scenedesmus obliquus, Anabaenopsis, Aulosira, Cylindrospermum, Synechoccus* sp., *Synechocystis* sp., or *Tolypothrix*.

Preferably, the host photosynthetic microorganism is a cyanobacterium. Cyanobacteria, also known as blue-green algae, are a broad range of oxygenic photoautotrophs. The host cyanobacterium can be any photosynthetic microorganism from the phylum Cyanophyta. The host cyanobacterium can have a unicellular or colonial (e.g., filaments, sheets, or balls) morphology. Preferably, the host cyanobacterium is a unicellular cyanobacterium. Examples of cyanobacteria that can be a host organism include, but are not limited to, the genus *Synechocystis, Synechococcus, Thermosynechococcus, Nostoc, Prochlorococcu, Microcystis, Anabaena, Spirulina,* and *Gloeobacter*. Preferably the host cyanobacterium is a *Synechocystis* spp. or *Synechococcus* spp. More preferably, the host cyanobacterium is *Synechococcus elongatus* PCC 7942 (ATCC 33912) or *Synechocystis* spp. PCC 6803 (ATCC 27184).

The host cell or organism can comprise an endogenous nitrogen control system. The genome of the host cell or organism can encode an NtcA polypeptide. The host cell or organism can express an NtcA polypeptide according to a nitrogen control system. Alternatively, a host cell or organism can be engineered to encode an NtcA polypeptide or express an NtcA polypeptide according to a nitrogen source.

As described herein, unregulated expression of a transcribable nucleic acid molecule can decrease growth rate of a host cell or organism or reduce viability of a host cell or organism (see Example 4). Various embodiments of the expression system described herein can provide for nitrogen-sensitive regulation of expression of a transcribable nucleic acid molecule, thereby providing increased growth rates or viability of the transformed host as compared to unregulated expression. Using an expression system described herein, a transformed host cell or organism can have less than about a 20% lower growth rate (e.g., less than about a 15%, 10%, or 5% lower growth rate) than a non-transformed host cell or organism under the same or substantially similar conditions. Using an expression system described herein, a transformed host cell or organism can have more than about a 5% higher growth rate (e.g., more than about a 10%, 15%, or 20% higher growth rate) than a host cell or organism transformed with a non-regulated construct grown under the same or substantially similar conditions. The above discussion applies equally to viability, where viability is substituted for growth rate.

Kits

Also provided are kits. Such kits can include an agent or composition described herein and, in certain embodiments, instructions for administration. Such kits can facilitate performance of the methods described herein. When supplied as a kit, the different components of the composition can be packaged in separate containers and admixed immediately before use. Components include, but are not limited to an expression system or expression cassette described herein, or components or sequences thereof. Such packaging of the components separately can, if desired, be presented in a pack or dispenser device which may contain one or more unit dosage forms containing the composition. The pack may, for example, comprise metal or plastic foil such as a blister pack. Such packaging of the components separately can also, in certain instances, permit long-term storage without losing activity of the components.

Kits may also include reagents in separate containers such as, for example, sterile water or saline to be added to a lyophilized active component packaged separately. For example, sealed glass ampules may contain a lyophilized component and in a separate ampule, sterile water, sterile saline or sterile each of which has been packaged under a neutral non-reacting gas, such as nitrogen. Ampules may consist of any suitable material, such as glass, organic polymers, such as polycarbonate, polystyrene, ceramic, metal or any other material typically employed to hold reagents. Other examples of suitable containers include bottles that may be fabricated from similar substances as ampules, and envelopes that may consist of foil-lined interiors, such as aluminum or an alloy. Other containers include test tubes, vials, flasks, bottles, syringes, and the like. Containers may have a sterile access port, such as a bottle having a stopper that can be pierced by a hypodermic injection needle. Other containers may have two compartments that are separated by a readily removable membrane that upon removal permits the components to mix. Removable membranes may be glass, plastic, rubber, and the like.

In certain embodiments, kits can be supplied with instructional materials. Instructions may be printed on paper or other substrate, or may be supplied as an electronic-readable medium, such as a floppy disc, mini-CD-ROM, CD-ROM, DVD-ROM, Zip disc, videotape, audio tape, and the like. Detailed instructions may not be physically associated with the kit; instead, a user may be directed to an Internet web site specified by the manufacturer or distributor of the kit.

Molecular Engineering

Design, generation, and testing of the variant nucleotides, and their encoded polypeptides, having the above required percent identities and retaining a required activity of the expressed protein is within the skill of the art. For example, directed evolution and rapid isolation of mutants can be according to methods described in references including, but not limited to, Link et al. (2007) Nature Reviews 5(9), 680-688; Sanger et al. (1991) Gene 97(1), 119-123; Ghadessy et al. (2001) Proc Natl Acad Sci USA 98(8) 4552-4557. Thus, one skilled in the art could generate a large number of nucleotide or polypeptide variants having, for example, at least 95-99% identity to the reference sequence described herein and screen such for desired phenotypes according to methods routine in the art. Generally, conservative substitutions can be made at any position so long as the required activity is retained.

Nucleotide or amino acid sequence identity percent (%) is understood as the percentage of nucleotide or amino acid residues that are identical with nucleotide or amino acid residues in a candidate sequence in comparison to a reference sequence when the two sequences are optimally aligned (with appropriate insertions, deletions, or gaps totaling less than about 20 percent of the reference sequence over the window of comparison). To determine percent identity, sequences are aligned and if necessary, gaps are introduced to achieve the maximum percent sequence identity. Sequence alignment procedures to determine percent identity are well known to those of skill in the art and include tools such as the local homology algorithm of Smith and Waterman, the homology alignment algorithm of Needleman and Wunsch, the search for similarity method of Pearson and Lipman, and preferably by computerized implementations (e.g., GAP, BESTFIT, FASTA, and TFASTA) of these algorithms. Often publicly available computer software such as BLAST, BLAST2, ALIGN2 or Megalign (DNASTAR) software is used to align sequences. Those skilled in the art can determine appropriate parameters for measuring alignment, including any algorithms needed to achieve maximal alignment over the full-length of the sequences being compared. When sequences are aligned, the percent sequence identity of a given sequence A to, with, or against a given sequence B (which can alternatively be phrased as a given sequence A that has or comprises a certain percent sequence identity to, with, or against a given sequence B) can be calculated as: percent sequence identity=X/Y100, where X is the number of residues scored as identical matches by the sequence alignment program's or algorithm's alignment of A and B and Y is the total number of residues in B. If the length of sequence A is not equal to the length of sequence B, the percent sequence identity of A to B will not equal the percent sequence identity of B to A.

As used herein, the term "substantial percent sequence identity" refers to a percent sequence identity of at least about 70% sequence identity, at least about 80% sequence identity, at least about 90% sequence identity, or even greater sequence identity, such as about 98% or about 99% sequence identity. Thus, one embodiment is a nucleic acid molecule that has at least about 70% sequence identity, at least about 80% sequence identity, at least about 90% sequence identity, or even greater sequence identity, such as about 98% or about 99% sequence identity with a nucleic acid sequence described herein. Nucleic acid molecules that are capable of regulating transcription of operably linked transcribable nucleic acid molecules and have a substantial percent sequence identity to the nucleic acid sequences of the expression systems provided herein are encompassed within the scope of this disclosure.

"Highly stringent hybridization conditions" are defined as hybridization at 65° C. in a 6×SSC buffer (i.e., 0.9 M sodium chloride and 0.09 M sodium citrate). Given these conditions, a determination can be made as to whether a given set of sequences will hybridize by calculating the melting temperature ($T_m$) of a DNA duplex between the two sequences. If a particular duplex has a melting temperature lower than 65° C. in the salt conditions of a 6×SSC, then the two sequences will not hybridize. On the other hand, if the melting temperature is above 65° C. in the same salt conditions, then the sequences will hybridize. In general, the melting temperature for any hybridized DNA:DNA sequence can be determined using the following formula: $T_m$=81.5° C.+16.6($\log_{10}[Na^+]$)+0.41(fraction G/C content)−0.63(% formamide)−(600/l). Furthermore, the $T_m$ of a DNA:DNA hybrid is decreased by 1-1.5° C. for every 1% decrease in nucleotide identity (see e.g., Sambrook and Russel, 2006).

Host cells can be transformed using a variety of standard techniques known to the art (see, e.g., Sambrook and Russel (2006) Condensed Protocols from Molecular Cloning: A Laboratory Manual, Cold Spring Harbor Laboratory Press, ISBN-10: 0879697717; Ausubel et al. (2002) Short Protocols in Molecular Biology, 5th ed., Current Protocols, ISBN-10: 0471250929; Sambrook and Russel (2001) Molecular Cloning: A Laboratory Manual, 3d ed., Cold Spring Harbor Laboratory Press, ISBN-10: 0879695773; Elhai, J. and Wolk, C. P. 1988. Methods in Enzymology 167, 747-754). Such techniques include, but are not limited to, viral infection, calcium phosphate transfection, liposome-mediated transfection, microprojectile-mediated delivery, receptor-mediated uptake, cell fusion, electroporation, and the like. The transfected cells can be selected and propagated to provide recombinant host cells that comprise the expression vector stably integrated in the host cell genome.

Host strains developed according to the approaches described herein can be evaluated by a number of means known in the art (see e.g., Studier (2005) Protein Expr Purif. 41(1), 207-234; Gellissen, ed. (2005) Production of Recombinant Proteins: Novel Microbial and Eukaryotic Expression Systems, Wiley-VCH, ISBN-10: 3527310363; Baneyx (2004) Protein Expression Technologies, Taylor & Francis, ISBN-10: 0954523253).

Methods of down-regulation or silencing genes are known in the art. For example, expressed protein activity can be down-regulated or eliminated using antisense oligonucleotides, protein aptamers, nucleotide aptamers, and RNA interference (RNAi) (e.g., small interfering RNAs (siRNA), short hairpin RNA (shRNA), and micro RNAs (miRNA) (see e.g., Fanning and Symonds (2006) Handbook Exp Pharmacol. 173, 289-303G, describing hammerhead ribozymes and small hairpin RNA; Helene, C., et al. (1992) Ann. N.Y. Acad. Sci. 660, 27-36; Maher (1992) Bioassays 14(12): 807-15, describing targeting deoxyribonucleotide sequences; Lee et al. (2006) Curr Opin Chem Biol. 10, 1-8, describing aptamers; Reynolds et al. (2004) Nature Biotechnology 22(3), 326-330, describing RNAi; Pushparaj and Melendez (2006) Clinical and Experimental Pharmacology and Physiology 33(5-6), 504-510, describing RNAi; Dillon et al. (2005) Annual Review of Physiology 67, 147-173, describing RNAi; Dykxhoorn and Lieberman (2005) Annual Review of Medicine 56, 401-423, describing RNAi). RNAi molecules are commercially available from a variety of sources (e.g., Ambion, Tex.; Sigma Aldrich, Mo.; Invitrogen). Several siRNA molecule design programs using a variety of algorithms are known to the art (see e.g., Cenix algorithm, Ambion; BLOCK-iT™ RNAi Designer, Invitrogen; siRNA Whitehead Institute Design Tools, Bioinformatics & Research Computing). Traits influential in defining optimal siRNA sequences include G/C content at the termini of the siRNAs, Tm of specific internal domains of the siRNA, siRNA length, position of the target sequence within the CDS (coding region), and nucleotide content of the 3' overhangs.

Definitions and methods described herein are provided to better define the present disclosure and to guide those of ordinary skill in the art in the practice of the present disclosure. Unless otherwise noted, terms are to be understood according to conventional usage by those of ordinary skill in the relevant art.

In some embodiments, numbers expressing quantities of ingredients, properties such as molecular weight, reaction conditions, and so forth, used to describe and claim certain embodiments of the present disclosure are to be understood as being modified in some instances by the term "about." In some embodiments, the term "about" is used to indicate that a value includes the standard deviation of the mean for the device or method being employed to determine the value. In some embodiments, the numerical parameters set forth in the written description and attached claims are approximations that can vary depending upon the desired properties sought to be obtained by a particular embodiment. In some embodiments, the numerical parameters should be construed in light of the number of reported significant digits and by applying ordinary rounding techniques. Notwithstanding that the numerical ranges and parameters setting forth the broad scope of some embodiments of the present disclosure are approximations, the numerical values set forth in the specific examples are reported as precisely as practicable. The numerical values presented in some embodiments of the present disclosure may contain certain errors necessarily resulting from the standard deviation found in their respective testing measurements. The recitation of ranges of values herein is merely intended to serve as a shorthand method of referring individually to each separate value falling within the range. Unless otherwise indicated herein, each individual value is incorporated into the specification as if it were individually recited herein.

In some embodiments, the terms "a" and "an" and "the" and similar references used in the context of describing a particular embodiment (especially in the context of certain of the following claims) can be construed to cover both the singular and the plural, unless specifically noted otherwise. In some embodiments, the term "or" as used herein, including the claims, is used to mean "and/or" unless explicitly indicated to refer to alternatives only or the alternatives are mutually exclusive.

The terms "comprise," "have" and "include" are open-ended linking verbs. Any forms or tenses of one or more of these verbs, such as "comprises," "comprising," "has," "having," "includes" and "including," are also open-ended. For example, any method that "comprises," "has" or "includes" one or more steps is not limited to possessing only those one or more steps and can also cover other unlisted steps. Similarly, any composition or device that "comprises," "has" or "includes" one or more features is not limited to possessing only those one or more features and can cover other unlisted features.

All methods described herein can be performed in any suitable order unless otherwise indicated herein or otherwise clearly contradicted by context. The use of any and all examples, or exemplary language (e.g. "such as") provided with respect to certain embodiments herein is intended merely to better illuminate the present disclosure and does not pose a limitation on the scope of the present disclosure otherwise claimed. No language in the specification should be construed as indicating any non-claimed element essential to the practice of the present disclosure.

Groupings of alternative elements or embodiments of the present disclosure disclosed herein are not to be construed as limitations. Each group member can be referred to and claimed individually or in any combination with other members of the group or other elements found herein. One or more members of a group can be included in, or deleted from, a group for reasons of convenience or patentability. When any such inclusion or deletion occurs, the specification is herein deemed to contain the group as modified thus fulfilling the written description of all Markush groups used in the appended claims.

All publications, patents, patent applications, and other references cited in this application are incorporated herein by reference in their entirety for all purposes to the same extent as if each individual publication, patent, patent application or other reference was specifically and individually indicated to be incorporated by reference in its entirety for all purposes. Citation of a reference herein shall not be construed as an admission that such is prior art to the present disclosure.

Having described the present disclosure in detail, it will be apparent that modifications, variations, and equivalent embodiments are possible without departing the scope of the present disclosure defined in the appended claims. Furthermore, it should be appreciated that all examples in the present disclosure are provided as non-limiting examples.

EXAMPLES

The following non-limiting examples are provided to further illustrate the present disclosure. It should be appreciated by those of skill in the art that the techniques disclosed in the examples that follow represent approaches the inventors have found function well in the practice of the present disclosure, and thus can be considered to constitute examples of modes for its practice. However, those of skill in the art should, in light of the present disclosure, appreciate that many changes can be made in the specific embodiments that are disclosed and still obtain a like or similar result without departing from the spirit and scope of the present disclosure.

Example 1

Removal of Invertase Activity from the Cell

To accumulate sucrose, *Synechocystis* sp. PCC 6803 was engineered to remove the invertase (β-fructofuranosidase) activity from the cell since invertase hydrolyzes sucrose to glucose and fructose that are re-assimilated into normal metabolic functions within the cell. The gene encoding invertase, lim17 (SEQ ID NO: 140), was deleted from ATCC 27184 (LYB426) to yield LYB471. It was also deleted from the wild-type strain (LYB467) to yield LYB472. Over time, differences between these strains have developed such the loss of motility by LYB426 (Kamei et al. 2001).

The invertase-encoding gene lim17 was first deleted from LYB426 using the neomycin resistance marker to generate LYB443. Using sequential PCR, a deletion in lim17 (SEQ ID NO: 140) was created to leave large stretches of flanking DNA. The first PCR reaction was performed on LYB426 whole cell genomic DNA template using Sspinvdel-F (SEQ ID NO: 142) and Sspinvdel-R (SEQ ID NO: 143) as primers. The product of this reaction (Ssp6803 Invertase Deletion PCR 1; SEQ ID NO: 144) was used as a primer in the second reaction (with Sspinvdel-R2 (SEQ ID NO: 145) again using LYB426 whole cell genomic DNA as the template to create Ssp6803 Invertase Deletion PCR 2 (SEQ ID NO: 146). The secondary PCR product was digested with XbaI and SphI and then ligated into similarly digested pUC19 (SEQ ID NO: 139), creating pLybAL38 (SEQ ID NO: 147). A DNA fragment containing an aminoglycoside 3'-phosphotransferase gene (aph) and the uracil phosphoribosyl transferase gene (upp) from Bacillus subtilis 168 (Bs upp aph PCR) (SEQ ID NO: 220) was amplified from plasmid pLybAL8f (SEQ ID NO: 69) with the oligonucleotides bsuppkanmcs-F and bsuppkanPstI-R. This PCR product was digested with SalI and PstI and then ligated into pLybAL38 (SEQ ID NO: 147) that had been digested with SbfI and SalI, which are found between the lim17 (SEQ ID NO: 140) flanking sequences, creating pLybAL41 (SEQ ID NO: 221). Plasmid pLybAL41 was then linearized by restriction endonucleases digestion with AatII, which is found within the pUC 19 (SEQ ID NO: 139) backbone, and then transformed into LYB426 by the protocol of Eaton-Rye (2004) with minor modifications. In particular, the transformation mix was plated directly onto the agar plates instead of a membrane overlayed onto the agar plate. Antibiotic was then administered by lifting the agar, adding the antibiotic to the bottom of the Petri dish and then lowering the agar back into the dish. This modification was made solely to reduce the number of agar plates required by three-fold. Integration was selected on BG11-A plates containing 25 µg/ml neomycin. Colonies were analyzed for proper integration and complete segregation throughout all of the copies of the chromosome by amplification of the genomic DNA from whole cells using the oligonucleotides Sspinvdelscreen-F and Sspinvdelscreen-R. Wild type amplification yields a product of 2.8 kbp, whereas the deletion of lim17 (SEQ ID NO: 140) with the neomycin resistance marker and the B. subtilis upp gene yields a 3.7 kbp product.

Then the neomycin resistance marker in LYB443 was swapped with the marker for spectinomycin resistance (the added upp gene was also removed) and the invertase was deleted from LYB467. The spectinomycin resistance marker was amplified from plasmid pBSL175 (Alexeyev et al. 1995) with the oligonucleotides specSalI-F and specSbfI-R. The product of this reaction was then digested with SalI and SbfI, and then ligated into similarly digested pLybAL41 to generate pLybAL58. Double homologous recombination was performed, as described above, with strains LYB443 and LYB467 to yield strains LYB471 and LYB472, respectively. Integration was selected on BG11-A plates with 25 µg/ml spectinomycin. Proper integration and complete segregation of colonies were again examined by amplification of genomic DNA from whole cells using the oligonucleotides Sspinvdelscreen-F and Sspinvdelscreen-R. Deletion of lim17 (SEQ ID NO: 140) with the spectinomycin resistance marker yields a 2.6 kbp product.

Deletion of the invertase allowed sucrose to as evidenced by 1) comparison between LYB426 (wild type) and LYB443 run under conditions of salt exposure resulted in no measurable sucrose in the wild type but 3-fold increase over background for LYB443 and 2) LYB443 transformed with the asf gene and run under control of functional promoters indicated that sucrose had accumulated within cells and in the culture media.

Example 2

Reduction of Exopolysaccharide Expression

In addition, Synechocystis sp. PCC 6803 is known to produce significant quantities of an exopolysaccharide (EPS) in response to normal aging of the culture or under conditions of environmental stress on the cells (Panoff et al. 1988). The large amounts of EPS represent a considerable allocation of carbon and overall metabolic flux that could be shunted to sucrose production. The genetics of exopolysaccharide production in Synechocystis sp. PCC 6803 are relatively unknown, although EPS mutants have been selected (Panoff and Joset 1989). A large cluster of genes (almost 18 kbp in size) on the endogenous plasmid pSYSM have been speculated to be largely responsible for EPS production (Kaneko et al. 2003), based upon their homologies to known genes. To this end, the putative genes considered to be responsible for key biosynthetic pathways associated with EPS biosynthesis were removed from LYB472 to create LYB476.

A strategy similar to the deletion of the invertase was employed for the deletion of the presumed EPS locus. Similar to the above, sequential PCR was performed with the primary oligonucleotides epsko-F and epsko-R and then the secondary oligonucleotide pSYSM-R2. The secondary PCR product was digested with XbaI and SphI, and then ligated into similarly digested pLybAL41 to yield pLybAL61. The erythromycin resistance marker from plasmid pE194 (Horinouchi and Weisblum 1982) was amplified with the oligonucleotides MLSSalI-F and MLSSbfI-R. The resultant product was digested with SalI and SbfI and then ligated into similarly digested pLybAL61, yielding pLybAL62. Double homologous recombination of LYB472 with linearized pLybAL62 was performed as described above, creating strain LYB476. Colonies were analyzed for proper integration by PCR of whole cell DNA with the oligonucleotides EPSKOscreen-F and EPSKOscreen-R. Deletion results in a 3.2 kbp product, instead of the 18.7 kbp product of the wild type strain. The 3.2 kbp deletion could easily be observed, but amplifying the 18.7 kbp wild-type product presented difficulties, making amplification unsuitable for determining if there was complete segregation. Complete segregation was instead assessed by the loss of multiple PCR products using the oligonucleotide pairs EPSKOscreen-F/EPSKOint-R1, EPSKOint-F2/EPSKOint-R2, EPSKOint-F3/EPSKOint-R3, EPSKOint-F4/EPSKOint-R4 and EPSKOint-F1/EPSKOscreen-R, for which one or both of the oligonucleotides are found within the deleted region. Amplification of wild type DNA with these oligonucleotides yields the products EPS KO Sreen_Border 1, EPS KO int PCR 2, EPS KO int PCR 3, EPS KO int PCR 4 and EPS KO Sreen_Border 2, respectively.

Results showed that deletion of the above EPS genes resulted in a new engineered organism that displayed a >80% loss in EPS production as determined by the extraction and colorimetric assay described by Panoff and Joset, 1989 and Laurentin and Edwards, 2003. Furthermore, it appears that the modified organisms with reduced EPS biosynthesis have no reduction in growth rate or overall viability.

Example 3

ASF Expression from Nitrite Reductase Promoter

The following example shows ASF expression from the Synechocystis sp. PCC 6803 or Synechococcus elongatus PCC 7942 nitrite reductase promoters.

LYB476, the strain of *Synechocystis* sp. bearing the plasmid comprising the nitrite reductase promoter from *Synechococcus elongatus* PCC7942 in front of the asf gene (pLybAL18) but with reduced EPS expression, was cultured in 50 ml of BG11 medium adjusted to pH 8.0 with 5 mM HEPES buffer supplemented with 24 µg/ml chloramphenicol and 4 mM ammonium chloride substituted for potassium nitrate as a nitrogen source. (Plasmid pLybAL18, and generation thereof, is as described in U.S. App. Pub. No. 2009/0181434, incorporated herein by reference in its entirety. Plasmid pLybAL18 was introduced into LYB476 by triparental conjugation, as also described in U.S. App. Pub. No. 2009/0181434.) The cultivation was performed at 28° C. in shake flasks at 250 RPM under 100 µE illumination with white LEDs. Following four days of fermentation the cells were harvested aseptically by centrifugation, washed once with 1× volume of sterile deionized water. The pelleted cells were redispersed into 50 ml fresh BG11 medium containing 20 mM potassium nitrate and 25 mg/ml chloramphenicol pH 9.0. The culture was shaken at 250 RPM and 28° C. for 24 hours under 100 mE illumination. The culture media was separated from the cells by centrifugation and the media was assayed for sucrose concentration using an enzyme based colorimetric method (Biovision Sucrose Assay Kit #K626). Cells were subjected to detergent lysis and the clarified supernatant was assayed for sucrose concentration using the enzyme based method described above.

LYB476, bearing the asf gene via the pLybAL18 plasmid, expressed sucrose into the culture media and composed between 30 and 50 percent by weight of the dry biomass of cells in the original culture. The concentration of sucrose liberated from the cells upon lysis corresponded to less than 10% by weight of the total sucrose observed in the culture.

LYB476 was alternatively transformed with a different plasmid carrying a nitrite reductase promoter from *Synechocystis* sp.PCC 6803 in front of the asf gene, pLybAL16, and cultured in 50 ml of BG11 medium adjusted to pH 8.0 with 5 mM HEPES buffer supplemented with 25 µg/ml chloramphenicol and 4 mM ammonium chloride substituted for potassium nitrate as a nitrogen source. (Plasmid pLybAL16, and generation thereof, is as described in U.S. App. Pub. No. 2009/0181434, incorporated herein by reference in its entirety. Plasmid pLybAL16 was introduced into LYB476 by triparental conjugation, as described in U.S. App. Pub. No. 2009/0181434.) The cultivation was performed at 28° C. in shake flasks at 250 RPM under 100 µE illumination with white LEDs. Following four days of fermentation the cells were harvested aseptically by centrifugation, washed once with 1× volume of sterile deionized water. The pelleted cells were redispersed into 50 ml fresh BG11 medium containing 20 mM potassium nitrate and 25 mg/ml chloramphenicol pH 9.0. The culture was shaken at 250 RPM and 28° C. for 24 hours under 100 mE illumination. The culture media was separated from the cells by centrifugation and the media was assayed for sucrose concentration using an enzyme based colorimetric method (Biovision Sucrose Assay Kit #K626). Cells were subjected to detergent lysis and the clarified supernatant was assayed for sucrose concentration using the enzyme based method described above.

Results from LYB476 bearing the plasmid pLybAL16 showed sucrose was observed primarily in the culture media composing between 30 and 50 percent by weight of the dry biomass of cells in the original culture. The concentration of sucrose liberated from the cells upon lysis corresponded to less than 10% by weight of the total sucrose observed in the culture.

Example 4

ASF Expression from the *Synechocystis* Sp. PCC 6803 or *Synechococcus elongatus* PCC 7942 RuBisCo promoters, as well as SPS and SPP Co-Expression from the *Synechocystis* Sp. PCC 6803 RuBisCo Promoter The ribulose-1,5-bisphosphate carboxylase oxygenase (RuBisCo) promoter from cyanobacteria is thought to be one of the strongest known promoters, since RuBisCo is one of the proteins expressed in highest abundance in the biosphere. Isolation and cloning of this promoter from both *Synechocystis* sp. PCC 6803 and *Synechococcus elongatus* PCC 7942 and placement in front of the sucrose producing asf gene was successfully accomplished and verified. The results suggested that production of sucrose by expressing asf under RuBisCo promoters control leads to growth inhibition, presumably due to the over allocation of resources toward sucrose production. These results further suggest that the regulation sucrose production during periods of biomass buildup is required.

The $\lambda_{PR}$ promoter and CI from plasmid pLybAL19 (as described in U.S. App. Pub. No. 2009/0181434) were replaced by the RuBisCo promoters from *Synechocystis* sp. PCC 6803 and *Synechococcus elongatus* PCC 7942. The *Synechocystis* sp. PCC 6803 and *Synechococcus elongatus* PCC 7942 RuBisCo promoters were amplified from whole cell genomic DNA using the oligonucleotide pairs SsprbcL-F/SsprbcL-R and SelorbcL-F/SelorbcL-R, respectively. The PCR products were digested with XbaI and AflII and ligated into similarly digested pLybAL19 to create pLybAL42 and pLybAL43 for the *Synechocystis* sp. PCC 6803 and *Synechococcus elongatus* PCC 7942 RuBisCo promoters, respectively.

Triparental conjugation (as described in U.S. App. Pub. No. 2009/0181434) was employed to insert plasmids pLybAL42 and pLybAL43 into strain LYB472. But transconjugants would appear and then turn brown and die off upon their restreaking, to purify the plasmid bearing strain away from the *E. coli* donor and helper strains. It was thought that this could be due to extreme sucrose production.

Also produced was a homologous recombinant sucrose production system where the *Synechocystis* sp. PCC 6803 sps and spp genes was placed behind the *Synechocystis* sp. PCC 6803 RuBisCo promoter in the context of the *Synechocystis* sp. PCC 6803 RuBisCo operon (rbcLXS) (SEQ ID NO: 233), and terminated by the presumed rbcLXS terminator. A C-terminal $His_6$-tagged sps open reading frame started at the start of rbcL and ended at the end of rbcX. A C-terminal $His_6$-tagged spp open reading frame replaced rbcS. To assemble this construct, the artificial operon, except for a 1.3 kbp XmaI/SpeI fragment within sps, with flanking XbaI and PmeI sites was synthesized (Blue Heron, Bothell, Wash.). This XbaI/PmeI fragment was placed into plasmid pLybAL50, (a derivative pLybAL19) digested with XbaI and ClaI (blunt-ended with T4 DNA polymerase) creating plasmid pLybAL66. The XmaI/SpeI fragment of sps was amplified by PCR from LYB467 whole cell genomic DNA with the oligonucleotides Ssp6803spsXS-F and Ssp6803spsXS-R. The product was digested with XmaI and SpeI and ligated into similarly digested pLybAL66, creating pLybAL67.

Both pLybAL66 and pLybAL67 were transferred into LYB472 by triparental conjugation. Transconjugants of pLybAL66 (having an incomplete sps) appeared healthy. But transconjugants of pLybAL67 (having a complete sps)

behaved the same as those of pLybAL42 and pLybAL43. A few green colonies of LYB472 with pLybAL67 did appear over time. Some of these were grown in BG11-A with 25 μg/ml chloramphenicol. Plasmid DNA was purified with the Wizard Plus SV Miniprep Kit (Promega, Madison, Wis.), with the addition of 1 minute of treatment with glass beads in a bead beater after resuspension of the pellet. The low quantity of purified plasmid DNA was amplified by transformation into *E. coli* NEB5alpha (NEB, Ipswich, Mass.). The DNA was again miniprepped and subjected to restriction analysis, where some isolates did not match the original plasmid DNA. Isolates that looked correct by restriction analysis presumably contained either very small deletions/insertions or point mutations. In either case, further analyses of the sequences of these plasmids were not pursued.

Some pLybAL67 transconjugants, however, were qualitatively analyzed for sucrose production. Briefly, small isolated colonies of LYB472 bearing either plasmid pLybAL66 or pLybAL67 were harvested from an agar plate using a sterile drawn glass whisker tube and transferred to 50 microliters of BG11A medium supplemented with chloramphenicol. This microculture was then positioned in a sterile multiwell tray as a hanging drop above 1 ml of a pool of cell free culture media to in order to prevent evaporative loss of the hanging drop solution. After 7 days the drops were collected, biomass was removed by centrifugation and the supernatant (spent culture broth) was assayed for the presence of sucrose. Strong colorimetric response was observed in cultures growing LYB472 bearing pLybAL67 while cultures of LYB472 with no plasmid or LYB472 pLybAL66 displayed no significant response. The quantitative assay of sucrose in these samples was not possible given the extremely low level of biomass in the samples, however, qualitative analysis suggested that significant sucrose production was observed with a fully functional RuBisCo promoter upstream of the asf gene for LYB472 bearing pLybAL67. Attempts to scale LYB472 bearing pLybAL67 resulted in extremely slow growth that ceased after several days resulting in pale yellow to whitish cells that appeared to lose viability over time.

Example 5

Esterase Expression from Variations of the *Nostoc* Sp. PCC 7120 RuBisCo Promoter The following example shows Esterase expression from variations of the *Nostoc* sp. PCC 7120 RuBisCo promoter.

The results of pLybAL42, pLybAL43, pLybAL66 and pLybAL67 suggested that the RuBisCo promoter may be able to synthesize enough enzyme for sucrose production, but production needed to be down-regulated during the biomass accumulation phase (see Example 3). In addition, regulation should be inexpensive to economically produce a commodity product. While prior reports have showed NtcA used to control expression (see e.g., Jiang et al. 1997; Herrero et al., 2001; Muro-Pastor et al., 2005), use in *Synechocystis* sp. PCC 6823 had not been reported.

The Ntca system in *Synechocystis* sp. PCC 6823 was first tested on a simple enzyme system, thermophilic carboxylesterase, that could be easily assayed. The thermophilic carboxylesterase gene was amplified by PCR from plasmid pCE020R using the oligonucleotides E020-F and E020-R, which also appended a C-terminal $His_6$-tag to the open reading frame. The PCR product was digested with NdeI and ClaI and ligated into similarly digested pLybAL50, thus creating pLybAL68 where the asf gene of LybAL50 was replaced with the esterase gene.

Next, CI and the lambda PR promoter were replaced with various fragments of the *Nostoc* sp PCC 7120 rbcLXS promoter. Four different constructs were made, containing the entire region, the core plus the downstream region, the core plus the upstream region and the core alone. These fragments were obtained by PCR amplification of *Nostoc* sp. PCC 7120 purified chromosomal DNA (ATCC #27893D-5) the oligonucleotide pairs Nsp7120rbcprom-F1/Nsp7120rbcprom-R1, Nsp7120rbcprom-F2/Nsp7120rbcprom-R1, Nsp7120rbcprom-F1/Nsp7120rbcprom-R2 and Nsp7120rbcprom-F2/Nsp7120rbcprom-R2, respectively. The PCR products were digested with SbfI and BamHI, and then ligated into similarly digested pLybAL68 to create pLybAL69, pLybAL70, pLybAL71 and pLybAL72, respectively.

Plasmids were introduced into LYB476 by triparental conjugation (as described in U.S. App. Pub. No. 2009/0181434).

*Synechocystis* sp. (LYB476) bearing the plasmid pLybAL69 (nitrogen regulated RuBisCo promoter sequence from *Nostoc* sp. PCC 7120 in front of the LYB E020 gene) was cultured in 50 ml of BG11 medium adjusted to pH 8.0 with 5 mM HEPES buffer supplemented with 25 μg/ml chloramphenicol and 4 mM ammonium chloride substituted for potassium nitrate as a nitrogen source. The cultivation was performed at 28° C. in shake flasks at 250 RPM under 100 μE illumination with white LEDs. Following four days of fermentation the cells were harvested aseptically by centrifugation, washed once with 1× volume of sterile deionized water. The pelleted cells were redispersed in minimal sterile water and equally split and inoculated into 25 ml fresh BG11 medium containing either 4 mM ammonium chloride or 20 mM potassium nitrate and 25 mg/ml chloramphenicol at pH 8.0 or pH 9.0 respectively. The culture was shaken at 250 RPM and 28° C. for 24 hours under 100 mE illumination. The culture media was separated from the cells by centrifugation and the cells were subjected to detergent lysis and the clarified supernatant was assayed for esterase activity using p-nitrophenol acetate colorimetric assay. Briefly, 100 μM p-nitrophenylacetate (from a 1 mM stock in acetonitrile) was dispersed in 50 mM phosphate buffer pH 7. The reaction was initiated by addition of 0.1 μl crude lysate and the formation of p-nitrophenate liberated from the hydrolysis reaction was followed at 348 nm (isosbestic point for the nitrophenol/nitrophenylate ion).

A strain of *Synechocystis* sp. (LYB476) bearing the plasmid pLybAL70 (nitrogen regulated RuBisCo promoter sequence from *Nostoc* sp. PCC 7120 in front of the LYB E020 gene) was cultured in 50 ml of BG11 medium adjusted to pH 8.0 with 5 mM HEPES buffer supplemented with 25 μg/ml chloramphenicol and 4 mM ammonium chloride substituted for potassium nitrate as a nitrogen source. The cultivation was performed at 28° C. in shake flasks at 250 RPM under 100 μE illumination with white LEDs. Following four days of fermentation the cells were harvested aseptically by centrifugation, washed once with 1× volume of sterile deionized water. The pelleted cells were redispersed in minimal sterile water and equally split and inoculated into 25 ml fresh BG11 medium containing either 4 mM ammonium chloride or 20 mM potassium nitrate and 25 mg/ml chloramphenicol at pH 8.0 or pH 9.0 respectively. The culture was shaken at 250 RPM and 28° C. for 24 hours under 100 mE illumination. The culture media was separated from the cells by centrifugation and the cells were subjected to detergent lysis and the clarified supernatant was assayed for esterase activity using p-nitrophenol acetate colorimetric assay as described above.

A strain of *Synechocystis* sp. (LYB476) bearing the plasmid pLybAL71 (nitrogen regulated RuBisCo promoter sequence from *Nostoc* sp. PCC 7120 in front of the LYB E020 gene) was cultured in 50 ml of BG11 medium adjusted to pH 8.0 with 5 mM HEPES buffer supplemented with 25 µg/ml chloramphenicol and 4 mM ammonium chloride substituted for potassium nitrate as a nitrogen source. The cultivation was performed at 28° C. in shake flasks at 250 RPM under 100 µE illumination with white LEDs. Following four days of fermentation the cells were harvested aseptically by centrifugation, washed once with 1× volume of sterile deionized water. The pelleted cells were redispersed in minimal sterile water and equally split and inoculated into 25 ml fresh BG11 medium containing either 4 mM ammonium chloride or 20 mM potassium nitrate and 25 mg/ml chloramphenicol at pH 8.0 or pH 9.0 respectively. The culture was shaken at 250 RPM and 28° C. for 24 hours under 100 mE illumination. The culture media was separated from the cells by centrifugation and the cells were subjected to detergent lysis and the clarified supernatant was assayed for esterase activity using p-nitrophenol acetate colorimetric assay as described above.

A strain of *Synechocystis* sp. (LYB476) bearing the plasmid pLybAL72 (nitrogen regulated RuBisCo promoter sequence from *Nostoc* sp. PCC 7120 in front of the LYB E020 gene) was cultured in 50 ml of BG11 medium adjusted to pH 8.0 with 5 mM HEPES buffer supplemented with 25 µg/ml chloramphenicol and 4 mM ammonium chloride substituted for potassium nitrate as a nitrogen source. The cultivation was performed at 28° C. in shake flasks at 250 RPM under 100 µE illumination with white LEDs. Following four days of fermentation the cells were harvested aseptically by centrifugation, washed once with 1× volume of sterile deionized water. The pelleted cells were redispersed in minimal sterile water and equally split and inoculated into 25 ml fresh BG11 medium containing either 4 mM ammonium chloride or 20 mM potassium nitrate and 25 mg/ml chloramphenicol at pH 8.0 or pH 9.0 respectively. The culture was shaken at 250 RPM and 28° C. for 24 hours under 100 mE illumination. The culture media was separated from the cells by centrifugation and the cells were subjected to detergent lysis and the clarified supernatant was assayed for esterase activity using p-nitrophenol acetate colorimetric assay as described above.

Results showed that the expression of the carboxyesterase gene corresponds to a thermophilic esterase that was cloned and engineered to contain a 6×Hisidine tag on the carboxy-terminus of the polypeptide. The enzyme is extremely stable and shown to be well expressed as a highly soluble active enzyme in a host of recombinant organisms. The colorimetric assay for enzyme activity is an extremely sensitive and quantitative means to determine protein expression yields. To this end, testing of plasmid constructs containing the NE020 gene provided a clear response to overall protein expression of the constructs tested. Using initial rates of enzyme turnover correlated to total protein measured in the each system provided a measure of enzyme produced. Furthermore, Western blotting analysis of the lysed biomass using antibodies raised against the 6×His tag attached to the protein provided insight into the levels of protein expressed in each sample and also provided a means to validate the kinetic assay data.

Example 6

ASF Expression from Variations of the *Nostoc* Sp. PCC 7120 RuBisCo Promoter

The following example shows ASF expression from variations of the *Nostoc* sp. PCC 7120 RuBisCo promoter.

The carboxyesterase (E020) gene from plasmids pLybAL69, pLybAL70, pLybAL71 and pLybAL72 was replaced with the asf gene (bearing a C-terminal His6-tag) from plasmid pLybAL50. The asf gene in pLybAL50 was removed by digestion with BamHI and ClaI and placed into similarly digested pLybAL69, pLybAL70, pLybAL71 and pLybAL72 to created pLybDB2 (SEQ ID NO: 188), pLybDB3 (SEQ ID NO: 189), pLybDB4 (SEQ ID NO: 190) and pLybDB5 (SEQ ID NO: 191), respectively.

Plasmids were introduced into LYB476 by triparental conjugation (as described in U.S. App. Pub. No. 2009/0181434).

*Synechocystis* sp. (LYB476) bearing the plasmid pLybDB2 (SEQ ID NO: 188) (nitrogen regulated RuBisCo promoter sequence from *Nostoc* sp. PCC 7120 in front of the asf gene) was cultured in 50 ml of BG11 medium adjusted to pH 8.0 with 5 mM HEPES buffer supplemented with 25 µg/ml chloramphenicol and 4 mM ammonium chloride substituted for potassium nitrate as a nitrogen source. The cultivation was performed at 28° C. in shake flasks at 250 RPM under 100 µE illumination with white LEDs. Following four days of fermentation the cells were harvested aseptically by centrifugation, washed once with 1× volume of sterile deionized water. The cultivation was performed at 28° C. in shake flasks at 250 RPM under 100 µE illumination with white LEDs. Following four days of fermentation the cells were harvested aseptically by centrifugation, washed once with 1× volume of sterile deionized water. The pelleted cells were redispersed in minimal sterile water and equally split and inoculated into 25 ml fresh BG11 medium containing either 4 mM ammonium chloride or 20 mM potassium nitrate and 25 mg/ml chloramphenicol at pH 8.0 or pH 9.0 respectively. The culture was shaken at 250 RPM and 28° C. for 48 hours under 100 mE illumination. Cells were separated from culture medium and sucrose content in the spent culture medium was analyzed using a coupled enzyme bioassay from Biovision. The quantity of sucrose in the spent culture media was compared to similar sucrose measurements performed on retained samples of the ammonical spent culture media employed during the biomass accumulation phase of the cultivation. Control experiments were performed to measure residual sucrose content within cells following final induced cultivation and subsequent lysis of the final cell pellet.

*Synechocystis* sp. (LYB476) bearing the plasmid pLybDB3 (SEQ ID NO: 189) (truncated nitrogen regulated RuBisCo promoter sequence from *Nostoc* sp. PCC 7120 in front of the asf gene) was cultured in 50 ml of BG11 medium adjusted to pH 8.0 with 5 mM HEPES buffer supplemented with 25 µg/ml chloramphenicol and 4 mM ammonium chloride substituted for potassium nitrate as a nitrogen source. The cultivation was performed at 28° C. in shake flasks at 250 RPM under 100 µE illumination with white LEDs. Following four days of fermentation the cells were harvested aseptically by centrifugation, washed once with 1× volume of sterile deionized water. The cultivation was performed at 28° C. in shake flasks at 250 RPM under 100 µE illumination with white LEDs. Following four days of fermentation the cells were harvested aseptically by centrifugation, washed once with 1× volume of sterile deionized water. The pelleted cells were redispersed in minimal sterile water and equally split and inoculated into 25 ml fresh BG11 medium containing either 4 mM ammonium chloride or 20 mM potassium nitrate and 25 mg/ml chloramphenicol at pH 8.0 or pH 9.0 respectively. Cells were separated from culture medium and sucrose content in the spent culture medium was analyzed using a coupled enzyme bioassay from Biovision. The quantity of sucrose in the spent culture media was compared to similar sucrose measurements performed on retained samples of the ammonical spent culture media employed during the biomass accumulation phase of the cultivation. Control experiments were performed to measure residual sucrose content within cells following final induced cultivation and subsequent lysis of the final cell pellet.

Synechocystis sp. (LYB476) bearing the plasmid pLybDB4 (SEQ ID NO: 190) (truncated nitrogen regulated RuBisCo promoter sequence from Nostoc sp. PCC 7120 in front of the asf gene) was cultured in 50 ml of BG11 medium adjusted to pH 8.0 with 5 mM HEPES buffer supplemented with 25 µg/ml chloramphenicol and 4 mM ammonium chloride substituted for potassium nitrate as a nitrogen source. The cultivation was performed at 28° C. in shake flasks at 250 RPM under 100 µE illumination with white LEDs. Following four days of fermentation the cells were harvested aseptically by centrifugation, washed once with 1× volume of sterile deionized water. The pelleted cells were redispersed in minimal sterile water and equally split and inoculated into 25 ml fresh BG11 medium containing either 4 mM ammonium chloride or 20 mM potassium nitrate and 25 mg/ml chloramphenicol at pH 8.0 or pH 9.0 respectively. The culture was shaken at 250 RPM and 28° C. for 48 hours under 100 mE illumination. Cells were separated from culture medium and sucrose content in the spent culture medium was analyzed using a coupled enzyme bioassay from Biovision. The quantity of sucrose in the spent culture media was compared to similar sucrose measurements performed on retained samples of the ammonical spent culture media employed during the biomass accumulation phase of the cultivation. Control experiments were performed to measure residual sucrose content within cells following final induced cultivation and subsequent lysis of the final cell pellet.

Synechocystis sp. (LYB476) bearing the plasmid pLybDB5 (SEQ ID NO: 191) (truncated nitrogen regulated RuBisCo promoter sequence from Nostoc sp. PCC 7120 in front of the asf gene) was cultured in 50 ml of BG11 medium adjusted to pH 8.0 with 5 mM HEPES buffer supplemented with 25 µg/ml chloramphenicol and 4 mM ammonium chloride substituted for potassium nitrate as a nitrogen source. The cultivation was performed at 28° C. in shake flasks at 250 RPM under 100 µE illumination with white LEDs. Following four days of fermentation the cells were harvested aseptically by centrifugation, washed once with 1× volume of sterile deionized water. The pelleted cells were redispersed in minimal sterile water and equally split and inoculated into 25 ml fresh BG11 medium containing either 4 mM ammonium chloride or 20 mM potassium nitrate and 25 mg/ml chloramphenicol at pH 8.0 or pH 9.0 respectively. The culture was shaken at 250 RPM and 28° C. for 48 hours under 100 mE illumination. Cells were separated from culture medium and sucrose content in the spent culture medium was analyzed using a coupled enzyme bioassay from Biovision. The quantity of sucrose in the spent culture media was compared to similar sucrose measurements performed on retained samples of the ammonical spent culture media employed during the biomass accumulation phase of the cultivation. Control experiments were performed to measure residual sucrose content within cells following final induced cultivation and subsequent lysis of the final cell pellet.

Structure of the RuBisCo promoter sequence from Nostoc sp. PCC 7120 was according to Table 1.

TABLE 1

| Regions of Nostoc sp. PCC 7120 promoter (see FIG. 3) | |
| --- | --- |
| Element | Location |
| Region Depicted | −327 to +509 |
| SbfI Site | −327 to −320 |
| BamHI Site | +499 to +504 |
| Upstream Deletion | −319 to −162 |
| Downstream Deletion | +26 to +491 |
| Transcription Start | +1 |
| −10 Consensus | −11 to −6 |
| Promoter | −34 to −6 |
| Translation Start (rbcL) | +507 |
| Translation Start (all1523) | −310 |
| NtcA Consensus Site 1 | −5 to +9 |
| NtcA Binding Site 1 | −10 to +12 |
| NtcA Consensus Site 2 | −54 to −42 |
| NtcA Binding Site 2 | −54 to −42 |
| Factor 2 Binding Site | −77 to −15 |

The region depicted in FIG. 3 starts from the point where the SbfI site was introduced, through the first codon of rbcL (RuBisCo large subunit). The DNA sequence is taken from the published genome (Kaneko et al. 2001 DNA Res 8, 205-213). Numbering is relative to the start of transcription (+1). Lower case letters indicate mutations made to introduce the SbfI and BamHI restriction endonucleases sites. The sequence identified as the promoter covers the area that would be normally identified as a typical E. coli-type $\sigma^{70}$ promoter. A −10 consensus sequence (TATAAT) can be identified relative to the start of transcription. DNA footprint analysis was used to show that NtcA binds the DNA at two locations (see Kaneko et al. 2001 DNA Res 8, 205-213). The NtcA Consensus Site 1 highlighted in FIG. 3 is $GTN_{10}AC$. The NtcA Consensus Site 2 highlighted in FIG. 3 is $GTN_9AC$. Both are flanked by As and Ts. DNA footprint analysis suggests that a second protein (Factor 2) binds to the promoter region (see Ramasubramanian et al. 1994 J Bacteriol 176, 1214-1223).

Sucrose measurements were performed on cell free spent culture media and normalized to total dry biomass and corrected for background glucose in each sample.

Results showed that the promoter construct composed of the entire segment region surrounding the nitrogen regulated RuBisCo promoter afforded little to no detectable sucrose as did the construct missing both flanking regions of sequence. The constructs with either the leading or trailing regions of sequence deleted individually demonstrated significant sucrose production (between 0.15 and 0.9 grams of sugar/gram of dry biomass.) The sucrose yields were shown to be dependent on the nitrogen source in the culture media with ammonia containing cultures affording 3-5 fold increase in sugar yields compared to nitrate composed culture solutions. Western Blot analysis performed to detect the presence of the asf (containing a 6× Histidine tag) protein demonstrated measurable quantities of protein for the constructs with single leading or trailing sequence regions truncated which is consistent with the sucrose production findings. Control experiments in which ammonia or nitrate containing culture media demonstrated that the organisms tolerated nitrogen source switches without noticeable changes in the growth properties of the organism.

Example 7

SPS/SPP Two-Gene Operon Expression from Variations of the *Nostoc* sp. Pcc 7120 RuBisCo Promoter The carboxyesterase (E020) gene from plasmids pLybAL69, pLybAL70, pLybAL71 and pLybAL72 was replaced with the sps and spp genes (each bearing a C-terminal His6-tag) in their operon structure from plasmid pLybAL67. A fragment bearing the sps and spp genes was amplified by PCR from the pLybAL67 template with the oligonucleotides SPSSPP Forward #2 and SPSSPP Reverse. The PCR product was digested with BglII and NarI and placed into plasmids pLybAL69, pLybAL70 and pLybAL72 that had been digested with BamHI and ClaI to create plasmids pLybDB6 (SEQ ID NO: 235), pLybDB7 (SEQ ID NO: 236) and pLybDB9 (SEQ ID NO: 237), respectively. The sps/spp equivalent of plasmids pLybAL71 (E020) and pLybDB4 (SEQ ID NO: 190) (asf) which was to be named pLybDB8 was abandoned due to difficulties encountered during its construction.

Plasmids were introduced into LYB476 by triparental conjugation (as described in U.S. App. Pub. No. 2009/0181434).

*Synechocystis* sp. (LYB476) bearing the plasmid pLybDB6 (SEQ ID NO: 235) (nitrogen regulated RuBisCo promoter sequence from *Nostoc* sp. PCC 7120 in front of the *Synechocystis* sp. PCC 6803 sps/spp genes) was cultured in 50 ml of BG11 medium adjusted to pH 8.0 with 5 mM HEPES buffer supplemented with 25 μg/ml chloramphenicol and 4 mM ammonium chloride substituted for potassium nitrate as a nitrogen source. The cultivation was performed at 28° C. in shake flasks at 250 RPM under 100μ☐E illumination with white LEDs. Following four days of fermentation the cells were harvested aseptically by centrifugation, washed once with 1× volume of sterile deionized water. The pelleted cells were redispersed in minimal sterile water and equally split and inoculated into 25 ml fresh BG11 medium containing either 4 mM ammonium chloride or 20 mM potassium nitrate and 25 mg/ml chloramphenicol at pH 8.0 or pH 9.0 respectively. The culture was shaken at 250 RPM and 28° C. for 48 hours under 100 mE illumination. Cells were separated from culture medium and sucrose content in the spent culture medium was analyzed using a coupled enzyme bioassay from Biovision. The quantity of sucrose in the spent culture media was compared to similar sucrose measurements performed on retained samples of the ammonical spent culture media employed during the biomass accumulation phase of the cultivation. Control experiments were performed to measure residual sucrose content within cells following final induced cultivation and subsequent lysis of the final cell pellet.

*Synechocystis* sp. (LYB476) bearing the plasmid pLybDB7 (SEQ ID NO: 236) (truncated nitrogen regulated RuBisCo promoter sequence from *Nostoc* sp. PCC 7120 in front of the *Synechocystis* sp. PCC 6803 sps/spp genes) was cultured in 50 ml of BG11 medium adjusted to pH 8.0 with 5 mM HEPES buffer supplemented with 25 μg/ml chloramphenicol and 4 mM ammonium chloride substituted for potassium nitrate as a nitrogen source. The cultivation was performed at 28° C. in shake flasks at 250 RPM under 100 μE illumination with white LEDs. Following four days of fermentation the cells were harvested aseptically by centrifugation, washed once with 1× volume of sterile deionized water. The pelleted cells were redispersed in minimal sterile water and equally split and inoculated into 25 ml fresh BG11 medium containing either 4 mM ammonium chloride or 20 mM potassium nitrate and 25 mg/ml chloramphenicol at pH 8.0 or pH 9.0 respectively. The culture was shaken at 250 RPM and 28° C. for 48 hours under 100 mE illumination. Cells were separated from culture medium and sucrose content in the spent culture medium was analyzed using a coupled enzyme bioassay from Biovision. The quantity of sucrose in the spent culture media was compared to similar sucrose measurements performed on retained samples of the ammonical spent culture media employed during the biomass accumulation phase of the cultivation. Control experiments were performed to measure residual sucrose content within cells following final induced cultivation and subsequent lysis of the final cell pellet.

*Synechocystis* sp. (LYB476) bearing the plasmid pLybDB9 (SEQ ID NO: 237) (truncated nitrogen regulated RuBisCo promoter sequence from *Nostoc* sp. PCC 7120 in front of the *Synechocystis* sp. PCC 6803 sps/spp genes) was cultured in 50 ml of BG11 medium adjusted to pH 8.0 with 5 mM HEPES buffer supplemented with 25 μg/ml chloramphenicol and 4 mM ammonium chloride substituted for potassium nitrate as a nitrogen source. The cultivation was performed at 28° C. in shake flasks at 250 RPM under 100 μE illumination with white LEDs. Following four days of fermentation the cells were harvested aseptically by centrifugation, washed once with 1× volume of sterile deionized water. The pelleted cells were redispersed in minimal sterile water and equally split and inoculated into 25 ml fresh BG11 medium containing either 4 mM ammonium chloride or 20 mM potassium nitrate and 25 mg/ml chloramphenicol at pH 8.0 or pH 9.0 respectively. The culture was shaken at 250 RPM and 28° C. for 48 hours under 100 mE illumination. Cells were separated from culture medium and sucrose content in the spent culture medium was analyzed using a coupled enzyme bioassay from Biovision. The quantity of sucrose in the spent culture media was compared to similar sucrose measurements performed on retained samples of the ammonical spent culture media employed during the biomass accumulation phase of the cultivation. Control experiments were performed to measure residual sucrose content within cells following final induced cultivation and subsequent lysis of the final cell pellet.

Sucrose measurements were performed on cell free spent culture media and normalized to total dry biomass and corrected for background glucose in each sample.

In accord with the results observed with the asf constructs, the promoter construct composed of the entire segment region surrounding the nitrogen regulated RuBisCo promoter upstream of the sps/spp genes afforded little detectable sucrose. The construct with both flanking regions of sequence deleted demonstrated modest sucrose yields, which is in variance to the results obtained with the asf constructs.

The construct with the leading segment of sequence deleted will be generated; however, the trailing deleted region of sequence significant sucrose production (between 0.15 and 0.3 grams of sugar/gram of dry biomass). The sucrose yields were shown to be insensitive to nitrogen source with both nitrate and ammonical nitrogen sources providing similar levels of sugar production. The yields of sucrose are significantly reduced in the sps/spp constructs relative as well as the overall regulatory control effectively realized.

Example 8

Plasmid Construction

The low copy vector pSMARTGC LK (Lucigen, Middleton, Wis.) (SEQ ID NO: 192), which is described by the manufacturer to be approximately 20 copies per cell, was used in the initial plasmids as the backbone for construction in *Escherichia coli* NEB5α (NEB, Ipswich, Mass.). Subsequent to that, pSMARTGC LK was replaced with pLG338 (SEQ ID NO: 202) (6 to 8 copies per cell). All PCR amplification were done using the Phusion polymerase as described by the manufacturer (NEB, Ipswich, Mass.).

The upp locus of *Synechocystis* sp. PCC 6803 was amplified by PCR from genomic DNA with the oligonucleotides Sspuppins-F (SEQ ID NO: 193) and Sspuppins-R (SEQ ID NO: 194) and cloned into the pSMARTGC LK vector as described by the manufacturer, creating pLybAL73f (SEQ ID NO: 195). The gene was divided and a multiple cloning site added by digesting pLybAL73f with FspI and KpnI, then inserting the phosphorylated annealed oligonucleotides SspuppMCS-F (SEQ ID NO: 196) and SspuppMCS-R (SEQ ID NO: 197), yielding plasmid pLybAL74f (SEQ ID NO: 198). Plasmid pLybAL75f (SEQ ID NO: 201) was then made from pLybAL74f by digesting pLybAL74f with FspI and SphI and ligating in the phosphorylated annealed oligonucleotides Selo7942rbcTerm-F (SEQ ID NO: 199) and Selo7942rbcTerm-R (SEQ ID NO: 200). This placed the *Synechococcus elongatus* PCC 7942 rubisco operon transcription terminator in front of the multiple cloning site to prevent expression of asf (SEQ ID NO: 1) from read-through transcripts produced by the upp promoter. Efforts were then made to clone asf along with the respective promoters from pLybDB3 (SEQ ID NO: 189) and pLybDB4 (SEQ ID NO: 190) into pLybAL75f so that their respective products could be linearized and then transformed into LYB476 for integration into the chromosome, but the correct products were never obtained.

An even lower copy number vector was then chosen, pLG338 (SEQ ID NO: 202) (6-8 copies per cell). Plasmid pLybAL78A (SEQ ID NO: 203) was constructed from pLG338 by partial digestion with SphI, followed by digestion with EcoRV, treatment with T4 polymerase to blunt the SphI site, and then religation of the 5.4 kbp vector. Plasmid pLybAL78A was then digested with PshAI and NheI, and then the HindIII (treated with T4 polymerase)-XbaI fragment bearing the *Synechocystis* sp. PCC 6803 upp locus with the intervening transcription terminator and multiple cloning site from pLybAL75f (SEQ ID NO: 201) was inserted, creating pLybAL79 (SEQ ID NO: 204). The SphI-ClaI (treated with T4 polymerase) fragments bearing asf along with the respective promoters from pLybDB3 (SEQ ID NO: 189) and pLybDB4 (SEQ ID NO: 190) were then successfully inserted into pLybAL79 digested with SphI and NotI (treated with T4 polymerase) to create pLybAL80 (SEQ ID NO: 205) and pLybAL81 (SEQ ID NO: 206), respectively.

To allow for selection by co-integration of an antibiotic resistance marker, plasmids pLybEA8 (SEQ ID NO: 238), pLybEA9 (SEQ ID NO: 239) and pLybEA10 (SEQ ID NO: 240) were made from pLybAL79, pLybAL80 and pLybAL81, respectively, by insertion of the chloramphenicol acetyltransferase gene from pKD32 (SEQ ID NO: 241) amplified using the oligonucleotides asfcmlint-F (SEQ ID NO: 242) and asfcmlint-R (SEQ ID NO: 243) and digested with SacII, into the SacII site. This yielded plasmids in which the asf gene and the downstream chloramphenicol acetyltransferase gene are convergently transcribed, without an intervening transcription terminator. Plasmids containing the chloramphenicol resistance marker in the opposite orientation of that in plasmids pLybEA8, pLybEA9 and pLybEA10 were contructed by their digestion with SacII and religation to create plasmids pLybAL84 (SEQ ID NO: 244), pLybAL85 (SEQ ID NO: 245) and pLybAL86 (SEQ ID NO: 246), respectively.

Vector construction for integration at the invertase locus began with plasmid pLybAL87b (SEQ ID NO: 247). Plasmid pLybAL87b was made from pLybEA8 by inserting a PCR product bearing the invertase locus with an intervening multiple cloning site. This PCR product was made by the successive PCR of *Synechocystis* sp. PCC 6803 wild-type chromosomal DNA with the oligonucleotides Sspinvint-F (SEQ ID NO: 248) and Sspinvint-R (SEQ ID NO: 249), followed by a secondary amplification using the product of the first reaction and the oligonucleotide Sspinvint-R2 (SEQ ID NO: 250) as primers. This final PCR product was digested with EcoRI and the 1.4 kbp product was inserted into the 4.9 kbp EcoRI fragment of pLybEA8, thus replacing the upp locus along with its intervening multiple cloning site and chloramphenicol resistance marker. Again, the *Synechococcus elongatus* PCC 7942 rubisco operon transcription terminator was placed upstream of the multiple cloning site to prevent read-through transcription of the asf gene by upstream promoters. Plasmid pLybAL87b was digested, with NotI and SphI and the phosphorylated annealed oligonucleotides Selo7942rbcTerm-F2 (SEQ ID NO: 251) and Selo7942rbcTerm-R2 (SEQ ID NO: 252) were inserted, creating pLybAL88b (SEQ ID NO: 253). To prevent unnecessary additional expression of the chloramphenicol resistance marker from promoters placed in front of the asf gene in the final constructs, a transcription terminator was also placed between the asf gene and the chloramphenicol resistance marker in plasmid pLybAL85 (SEQ ID NO: 245). Plasmid pLybAL85 was partially digested with both SacII and BamHI, and then the phosphorlyated annealed oligonucleotides Selo7942AIITerm-F (SEQ ID NO: 254) and Selo7942AIITerm-R (SEQ ID NO: 255) containing the *Synechococcus elongatus* PCC 7942 psbAII transcription terminator were inserted into the 9.5 kbp vector, creating pLybAL89 (SEQ ID NO: 256). Plasmids pLybAL88b and pLybAL89 were combined to make pLybAL90 (SEQ ID NO: 257). The 3.9 kbp SphI-KpnI fragment from pLybAL89 was ligated to the 6.3 kbp SphI-KpnI fragment from pLybAL88b. The 0.37 kbp SphI-BamHI fragment from plasmid pLybAL86 was then combined with the 9.6 kbp SphI-BamHI fragment from plasmid pLybAL90 to create pLybAL91 (SEQ ID NO: 258). Plasmid pLybAL91 contains the invertase locus split by a transcription terminator, the *Nostoc* sp PCC7120 rubisco promoter fragment from pLybDB4, asf, another transcription terminator and then the chloramphenicol resistance marker with its own promoter transcribed in the same direction as asf.

The invertase locus of plasmid pLybAL88b was swapped with the exopolysaccharide locus in two steps. First, *Synechocystis* sp. PCC 6803 wild-type chromosomal DNA was amplified with the oligonucleotides SspEPSint-F (SEQ ID NO: 259) and SspEPSint-R (SEQ ID NO: 260). The 0.67 kbp product of this reaction was digested with EcoRI and NotI and ligated to the similarly digested 5.7 kbp fragment of pLybAL88b, forming pLybAL93 (SEQ ID NO: 261). Second, *Synechocystis* sp. PCC 6803 wild-type chromosomal DNA was amplified with the oligonucleotides SspEPSint-F2 (SEQ ID NO: 262) and SspEPSint-R2 (SEQ ID NO: 263). The 1.1 kbp product of this reaction was digested with EcoRI and KpnI and ligated to the similarly digested 5.6 kbp fragment of pLybAL93, forming pLybAL94 (SEQ ID NO: 264). Plasmid pLybAL98 (SEQ ID NO: 265) was then created by ligating the 6.7 kbp SphI-KpnI fragment of pLybAL94 with the 3.6 kbp fragment of similarly digested pLybAL91. Plasmid pLybAL98 contains the exopolysaccharide locus split by a transcription terminator, the *Nostoc* sp PCC 7120 rubisco promoter fragment from pLybDB4, asf, another transcription terminator and then the chloramphenicol resistance marker with its own promoter transcribed in the same direction as asf.

The exopolysaccharide locus of plasmid pLybAL94 was swapped with the sps locus of *Synechocystis* sp. PCC 6803 in two steps. First, *Synechocystis* sp. PCC 6803 wild-type chromosomal DNA was amplified with the oligonucleotides Sspspsint-F (SEQ ID NO: 266) and Sspspsint-R (SEQ ID NO: 267). The 1.3 kbp product of this reaction was digested with RsrII and KpnI and ligated to the similarly digested 5.6 kbp fragment of pLybAL94, forming pLybAL95 (SEQ ID NO: 268). Second, *Synechocystis* sp. PCC 6803 wild-type chromosomal DNA was amplified with the oligonucleotides Sspspsint-F2 (SEQ ID NO: 269) and Sspspsint-R2 (SEQ ID NO: 270). The 0.92 kbp product of this reaction was digested with MreI and NotI and ligated to the similarly digested 6.3 kbp fragment of pLybAL95, forming pLybAL96 (SEQ ID NO: 271).

Plasmid pLybAL106 (SEQ ID NO: 272) and pLybAL107 (SEQ ID NO: 273) were constructed to integrate nitrate inducible nitrogen regulon regulatory proteins and invertase genes, respectively, along with the kanamycin resistance marker into the sps locus of *Synechocystis* sp. PCC 6803. First, the kanamycin resistance marker of pLybAL90 was deleted by digestion with MluI and relegation of the 8.7 kbp fragment, creating pLybAL100 (SEQ ID NO: 274). The chloramphenicol resistance marker of pLybAL100 was then replaced with the kanamycin resistance marker from pKD13 (SEQ ID NO: 275). The kanamycin resistance marker from pKD13 was amplified with the oligonucleotides neoflpint-F (SEQ ID NO: 276) and asfcmlint-R (a) (SEQ ID NO: 277). The 1.3 kbp product was digested with PacI and SacII and ligated to the 7.7 kbp fragment of similarly digested pLybAL100, creating pLybAL101 (SEQ ID NO: 278). Fragments containing the nirA promoter (SEQ ID NO: 32) from *Synechococcus elongatus* PCC 7942 followed by either the ntcA and ntcB (PnirA_ntcA_ntcB) (SEQ ID NO: 279) or invertase (PnirA_lim17) (SEQ ID NO: 280) genes from *Synechococcus elongatus* PCC 7942 were synthesized by Blueheron (Bothell, Wash.). The genes from *Synechococcus elongatus* PCC 7942 were used instead of those from *Synechocystis* sp. PCC 6803 to limit erroneous chromosomal recombination. These fragments (1.9 and 1.7 kbp) were digested with SbfI and PmeI and placed into the 6.2 kbp fragment of pLybAL101 to create pLybAL102 (SEQ ID NO: 281) and pLybAL103 (SEQ ID NO: 282), respectively. The nitrate inducible genes and kanamycin resistance markers from pLybAL102 and pLybAL103 were combined with the pLybAL96, for integration into the sps locus. The 3.2 and 3.1 kbp SbfI-SacII fragments from pLybAL102 and pLybAL103 were ligated to the 7.2 kbp fragment of similarly digested pLybAL96 to yield pLybAL106 (SEQ ID NO: 272) and pLybAL107 (SEQ ID NO: 273), respectively.

Example 9

Integration

For integration into strains of *Synechocystis* sp. PCC 6803, cells were grown in BG11-A (buffered with either HEPES at pH 8.0 or CHES at pH 9.0) to an $OD_{730}$ of approximately 0.4, pelleted by centrifugation and then resuspended in fresh medium to an $OD_{730}$ of 2.5. Better growth is observed when buffered with CHES at pH 9.0, but when the medium is supplemented with base sensitive compounds like neomycin and 5-fluoruracil, HEPES at pH 8.0 was used. Transformation was performed by mixing 2-10 μg of DNA (linearized with AflII and MluI) with 500 μl of this cell suspension, incubated under light in a clear plastic tube for 3 hrs, mixed and then incubated for another 3 hrs. The cell suspension was then applied to BG11-A agar plates containing 0.3% sodium thiosulfate. The plates were incubated overnight under constant illumination. After 24 hrs from the time the cells were plated, the agar on the plates was lifted and 50% of the antibiotic applied underneath the agar. The other 50% of the antibiotic was applied after 36 hrs. The final concentrations of chloramphenicol, neomycin and 5-fluorouracil were 25, 25 and 1 μg/ml, respectively. Candidates would be restreaked onto antibiotic containing plates, and then screened by colony PCR. This process would be repeated until complete segregation was observed. Upon complete segregation, the candidates would again be restreaked, this time in the absence of antibiotic. Candidates would again be screened by colony PCR to determine that complete segregation was maintained.

Integration was analyzed by PCR with oligonucleotides outside of the region of recombination. Integration at the upp locus was screened with the oligonucleotides Sspuppintscrn-F (SEQ ID NO: 283) and Sspuppintscrn-R (SEQ ID NO: 284). Wild-type upp, as found in strain LYB476, would yield a 0.89 kbp product. Proper integration with pLybAL81 (SEQ ID NO: 206), pLybEA8 (SEQ ID NO: 238), pLybEA10 (SEQ ID NO: 240), pLybAL84 (SEQ ID NO: 244) and pLybAL86 (SEQ ID NO: 246) would yield products of 3.4, 2.0, 4.5, 2.0 and 4.5 kbp, respectively. Integration at the invertase (lim17) locus was screened with the oligonucleotides Sspinvdelscreen-F (SEQ ID NO: 153) and Sspinvdelscreen-R (SEQ ID NO: 154). Amplification of the invertase locus from strain LYB476 would yield a 2.6 kbp product. Proper integration with pLybAL91 (SEQ ID NO: 258) would yield a product of 5.3 kbp. Integration at the exopolysaccharide locus was screened with the oligonucleotides EPSKOscreen-F (SEQ ID NO: 167) and EPSKOscreen-R (SEQ ID NO: 168). Amplification of the exopolysaccharide locus from strain LYB476 would yield a 3.2 kbp product. Proper integration with pLybAL98 (SEQ ID NO: 265) would yield a product of 5.6 kbp. Integration at the sps locus was screened with the oligonucleotides Ssp6803spsscreen-F (SEQ ID NO: 285) and Ssp6803spsscreen-R (SEQ ID NO: 286). Wild-type sps, as found in strain LYB476, would yield a 4.0 kbp product. Proper integration with plasmids pLybAL106 (SEQ ID NO: 272) and pLybAL107 (SEQ ID NO: 273) would yield products of 5.6 kbp and 5.4 kbp, respectively.

Plasmids pLybAL106 and pLybAL107 were linearized and transformed into strain LYB476 to yield LYB509 and LYB510, respectively. Plasmid pLybAL98 was linearized and transformed into LYB509 and LYB510 to yield LYB511 and LYB512, respectively.

Integration of asf at the upp Locus.

Attempts were made to integrate asf into the *Synechocystis* sp. PCC 6803 upp locus using pLybAL81, but were not successful. Plasmid pLybAL81 (SEQ ID NO: 206) was linearized with AflII and MluI, transformed into LYB476, and then transformants were selected on BG11-A plates containing 1 μg/ml 5-fluorouracil. Candidates were screened by PCR amplification from their genomic DNA using the oligonucleotides Sspuppintscrn-F (SEQ ID NO: 283) and Sspuppintscm-R (SEQ ID NO: 284). Proper integration would yield a PCR product of 3.4 kbp, instead of the wild-type 0.89 kbp. PCR products from the amplification of genomic DNA from the 5-fluorouracil resistant candidates obtained were the size of the wild-type DNA. These candidates could result from the spontaneous selection of 5-fluorouracil resistant mutants at either the upp locus or another locus, instead of asf integration. They were not characterized, however.

It was decided to select for the integration of asf at the upp locus by co-integration of an antibiotic resistance marker using plasmids pLybEA8 (SEQ ID NO: 238) and pLybEA10 (SEQ ID NO: 240). Plasmid pLybEA8 contains only the chloramphenicol resistance marker, whereas pLybEA10 also contains the asf gene transcribed from the *Nostoc* PCC 7120 rubisco promoter fragment found in plasmid pLybDB4 (SEQ ID NO: 190). Colonies were only obtained from transformation of LYB476 with linearized pLybEA8, the plasmid devoid of the asf gene. The upp locus was analyzed by PCR using the primers sspuppintscrn-F (SEQ ID NO: 283) and sspuppintscrn-R (SEQ ID NO: 284). Proper integration should produce a 2.0 kbp DNA fragment, instead of the wild-type 0.89 kbp. Both wild-type and integrant fragments were detected, indicating incomplete segregation. Repeated streaking with antibiotic selection failed to produce complete segregation. No colonies were obtained for the pLybEA10 transformations, the asf containing plasmid.

To ensure proper expression of the chloramphenicol resistance marker was not a problem for obtaining integration of asf, the orientation of the marker of plasmids pLybEA8 and pLybEA10 was reversed in pLybAL84 (SEQ ID NO: 244) and pLybAL86 (SEQ ID NO: 246), respectively. It was speculated that strong expression of asf might result in diminished expression of the downstream convergent cat gene. However, similar results were obtained.

Integration of asf at the Invertase and Exopolysaccharide Loci.

Integration at the upp locus was abandoned in favor of integration at the invertase and exopolysaccharide loci, for which it was known from previous work that the complete segregation of deletions of these genes was not problematic. LYB476 was transformed with the linearized pLybAL91 (SEQ ID NO: 258) and pLybAL98 (SEQ ID NO: 265) to integrate the asf gene into the invertase (lim17) locus on the chromosome and the exopolysaccharide locus located on the large plasmid pSYSM. Integration procedures afforded very small colonies which would begin to appear then, however, quickly die.

Integration of Asf at the Invertase and Exopolysaccharide Loci in Modified Hosts.

The lack of successful integration was suspected to be the result of sucrose production by ASF, which is expressed even when grown in nitrate-containing medium. Previous results with plasmid pLybDB4 (SEQ ID NO: 190) showed that expression was not completely shut down under non-inducing conditions. This led to efforts to reduce sucrose toxicity (which probably results from severe osmotic imbalance) by either reducing the basal level of asf expression (addition of excess NtcA and NtcB) or degradation of the sucrose causing the toxicity (addition of invertase activity). The genes encoding these proteins were placed behind the *Synechococcus elongatus* PCC 7942 nirA promoter, which is induced during growth on nitrate, but repressed during growth on ammonia. Plasmid pLybAL106 (SEQ ID NO: 272) and pLybAL107 (SEQ ID NO: 273) were used to integrate these constructs at the sps locus, leading to strains LYB509 and LYB510. These strains were constructed without any difficulty.

Integration of asf at the invertase locus of strains LYB509 and LYB510 with plasmid pLybAL91 (SEQ ID NO: 258) was still not successful. However, integration of asf at the exopolysaccharide locus in these strains with plasmid pLybAL98 (SEQ ID NO: 265) was, yielding LYB511 and LYB512, respectively.

In accordance with previous data from LYB476 bearing plasmid pLybDB4 (SEQ ID NO: 190), which showed increased sucrose production in response to urea induction. Urea induced cells secreted approximately 3-fold more sucrose than the cells grown in nitrate. Our results show that the LYB511 asf integrant also secretes sucrose in response to urea induction. LYB511 displayed a 4-5 fold increase in sucrose secretion in response to urea over nitrate. Interestingly, LYB511 treated with urea secreted 4 fold more sucrose than LYB476 bearing pLybDB4 treated with urea. In addition, LYB511 treated with nitrate also secreted 3-fold more sucrose than LYB476 bearing pLybDB4 treated with nitrate. These results indicate that the asf integrant produces more sucrose overall compared to expression of asf exogenous from the plasmid. The amount of sucrose obtained from the cell lysates was similar between all samples. These results indicate that the cells can only tolerate a finite concentration of internal sucrose prior to secretion. The sucrose assay results also infer stable endogenous expression of the asf gene.

The LYB512 strain does not show increased sucrose production in response to urea. The nitrogen regulatory control of the additional invertase expression must either be leaky or the invertase is very stable over time.

Example 10

Integrated Nitrogen Regulated Sucrose Production Ina Liquid State Photobioreactor Strain LYB511 was cultivated on BG11 agar culture media and single colonies were transferred to 50 ml of liquid BG11 culture media and shaken at 250 RPM at 30° C. under 50 microeinsteins white light until the culture is determined to enter log phase growth as determined by optical density measurements at 730 nm (nominally 3-4 days). The log phase culture is aseptically transferred into 500 ml of stirred BG11 culture broth maintained at 30° C., aerated with 1 volume of filtered air per minute under 150 microeinsteins white fluorescent light. Once the culture had achieved a mid log phase growth the cells were aseptically harvested by centrifugation and washed once with deionized water. The cell pellet was dispersed into 10 ml of deionized water and 5 ml was introduced into 500 ml of BG11 culture broth supplemented with 20 mM sodium nitrate or 10 mM urea. Cultures were grown at 30° C. with stirring and aeration at 1 volume air per minute under 150 microeinsteins of white fluorescent light. 10 ml of culture broth were removed daily over the course of 4 days and pH, biomass density and sucrose concentration were measured.

Results showed that, for the culture including sodium nitrate as the nitrogen source, biomass accumulation during the 4 day trial increased 2.25 fold with a peak sucrose concentration of 9.3 micromolar. For the culture including urea as the nitrogen source the biomass accumulation during the 4 day trial increased only 1.2 fold and the peak sucrose concentration was 83 micromolar. In both cultures the pH slowly increased from 7 to 7.8.

Example 11

Plasmid Based Nitrogen Regulated Sucrose Production in Solid State Photobioreactor Strain LYB476 bearing plasmid pLybDB4 was cultivated on BG11 agar culture media and single colonies were transferred to 50 ml of liquid BG11 culture media and shaken at 250 RPM at 30° C. under 50 microeinsteins white light until the culture is determined to enter log phase growth as determined by optical density measurements at 730 nm (nominally 3-4 days). The log phase culture is aseptically transferred into 3000 ml of stirred BG11 culture broth maintained at 30° C., aerated with 1 volume of filtered air per minute under 150 microeinsteins white fluorescent light.

Once the culture had achieved a mid log phase growth the cells were aseptically transferred to a sterile trough. Solid state photobioreactor (as described in US Patent Application 20090181434) fabric measuring 6 inches square was submerged in the trough and allowed to incubate overnight in the dark at room temperature. The fabric was aseptically installed into the solid state photobioreactor with gas and culture media plumbing attached. The gas source was ambient air filtered and introduced at 0.1 liters per minute. Culture media was introduced into the reactor at regular 4 hour intervals with 15 minutes active pumping at a flow rate of 0.2 ml per min. Cultures were grown at 30° C. under 150 microeinsteins of white fluorescent light. The initial culture media consisted of BG11 with 20 mM sodium nitrate as a nitrogen source which was transitioned after 5 days to BG11 containing 10 mM urea as nitrogen source and the fermentation continued over the course of 7 days. 10 ml of culture broth were removed daily over the course of the trial with pH and sucrose concentration measured. During the culture the pH remained at 7.2 in the collected effluent.

Results showed that the peak sucrose production during the nitrate phase feeding afforded 0.16 millimoles at a concentration of 8.8 mM sucrose. The peak sucrose production during the urea phase feeding afforded 0.94 millimoles at a concentration of 52 mM sucrose.

Example 12

Integrated Nitrogen Regulated Sucrose Production in a Solid State Photobioreactor Strain LYB511 was cultivated on BG11 agar culture media and single colonies were transferred to 50 ml of liquid BG11 culture media and shaken at 250 RPM at 30° C. under 50 microeinsteins white light until the culture is determined to enter log phase growth as determined by optical density measurements at 730 nm (nominally 3-4 days). The log phase culture is aseptically transferred into 3000 ml of stirred BG11 culture broth maintained at 30° C., aerated with 1 volume of filtered air per minute under 150 microeinsteins white fluorescent light. Once the culture had achieved a mid log phase growth the cells were aseptically transferred to a sterile trough. Solid state photobioreactor (as described in Patent Application 20090181434) fabric measuring 6 inches by 6 inches was submerged in the trough and allowed to incubate overnight in the dark at room temperature. The fabric was aseptically installed into the solid state photobioreactor with gas and culture media plumbing attached. The gas source was ambient air filtered and introduced at 0.1 liters per minute. Culture media was introduced into the reactor at regular 4 hour intervals with 15 minutes active pumping at a flow rate of 0.2 ml per min. Cultures were grown at 30 C under 150 microeinsteins of white fluorescent light. The initial culture media consisted of BG11 with 20 mM sodium nitrate as a nitrogen source which was transitioned after 5 days to BG11 containing 10 mM urea as a nitrogen source and the fermentation continued over the course of 7 days. 10 ml of culture broth were removed daily over the course of the trial with pH and sucrose concentration measured. During the culture the pH remained at 7.2 in the collected effluent.

Results showed that the peak sucrose production during the nitrate phase feeding afforded 0.32 millimoles at a concentration of 18 mM sucrose. The peak sucrose production during the urea phase feeding afforded 1.6 millimoles at a concentration of 91 mM sucrose.

REFERENCES

Herrero, A, Muro-Pastor, A M and E Flores. 2001. Nitrogen control of cyanobacteria. J Bact. 183:411-425.

Muro-Pastor, M I, Reyes, J C and F J Florencio. 2005. Ammonium assimilation in cyanobacteria. Photosynth Res. 83:135-150.

Emlyn-Jones, D, Price, G D and T J Andrews. 2003. Nitrogen-regulated hypermutator strain of *Synechococcus* sp. For use in in vivo artificial evolution. Appl Environ Microbiol. 69:6427-6433.

Kamei, A, Yuasa, T, Orikawa, K, Geng, X X and M Ikeuchi. 2001. A eukaryotic type protein kinase, SpkS, is required for normal motility of the unicellular cyanobacterium *Synechocystis* sp. strain PCC 6803. J Bact. 183:1505-1510.

Panoff, J-M, Priem, B, Morvan, H and F Joset. 1988. Sulphated exopolysaccharides produced by two unicellular strains of cyanobacteria, *Synechocystis* PCC 6803 and 6714. Arch Microbiol. 150:558-563.

Panoff, J.-M., Joset, F. 1989, Selection by anion-exchange chromatography of exopolysaccharide mutants of the cyanobacterium *Synechocystis* PCC 6803. Appl. Environ. Microbiol. 55, 1452-1456.

Laurentin, A., Edwards, C. A., 2003. A microtiter modification of the anthrone-sulfuric acid colorimetric assay for glucose-based carbohydrates. Anal. Biochem. 315, 143-145.

Kaneko T et al. 2001 Complete genomic sequence of the filamentous nitrogen-fixing cyanobacterium *Anabaena* sp. strain PCC 7120. DNA Res 8:205-213.

Nierzwicki-Bauer S A, Curtis S E and Haselkom R. 1984. Cotranscription of genes encoding the small and large subunits of ribulose-1,5-bisphosphate carboxylase in the cyanobacterium *Anabaena* 7120. Proc Natl Acad Sci USA 81:5961-5965.

Ramasubramanian T S, Wei T-F and Golden J W. 1994. Two *Anabaena* sp. strain PCC 7120 DNA-binding factors interact with vegetative cell- and heterocyst-specific genes. J Bacteriol 176:1214-1223.

Vázquez-Bermúdez M F, Flores E and Herrero A. 2002. Analysis of binding sites for the nitrogen-control transcription factor NtcA in the promoters of *Synechococcus* nitrogen-regulated genes. Biochemica et Biophysica Acta 1578:95-98.

SEQUENCE LISTING (286 sequences)

SEQ ID NO: 1 - DNA, 2204 bp, Synechococcus PCC7942
agactacaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaag

SEQ ID NO: 2 - protein, 709 aa, Synechococcus PCC7942
MAAQNLYILHIQTHGLLRGQNLELGRDADTGGQTKYVLELAQAQAKSPQVQQVDIITRQITDPRVSVGYSQAIEPFAPKGRIVRLPFGPKRYLRKELLWPHLYTFADAILQYLAQQKRTPTWIQAHYADAGQVGSLLSRWLNVPLIFTGHSLGRIKLKKLLEQDWPLEEIEAQFNIQQRIDAEEMTLTHADWIVASTQQEVEEQYRVYDRYNPERKLVIPPGVDTDRFRFQPLGDRGVVLQQELSRFLRDPEKPQILCLCRPAPRKNVPALVRAFGEHPWLRKKANLVLVLGSRQDINQMDRGSRQVFQEIFHLVDRYDLYGSVAYPKQHQADDVPEFYRLAAHSGGVFVNPALTEPFGLTILEAGSCGVPVVATHDGGPQEILKHCDFGTLVDVSRPANIATALATLLSDRDLWQCYHRNGIEKVPAHYSWDQHVNTLFERMETVALPRRRAVSFVRSRKRLIDAKRLVVSDIDNTLLGDRQGLENLMTYLDQYRDHFAFGIATGRRLDSAQEVLKEWGVPSPNFWVTSVGSEIHYGTDAEPDISWEKHINRNWNPQRIRAVMAQLPFLELQPEEDQTPFKVSFFVRDRHETVLREVRQHLRRHRLRLKSIYSHQEFLDILPLAASKGDAIRHLSLRWRIPLENILVAGDSGNDEEMLKGHNLGVVVGNYSPELEPLRSYERVYFAEGHYANGILEALKHYRFFEAIA

SEQ ID NO: 3 - DNA, 2163 bp, Synechocystis PCC6803
atgagctattcatcaaaatacattttactaattagtgtccatggtttaattcggggagaaaaccttgagttgggcagagatgccgacaccggcgggcaaaccaaatatgtgctggaactggcccgggccttggtaaaaaatccccaggtggccagggtggatttgctgacccgtttaattaaagatcccaaagtagatgcagattatgcccagcctagagaacttattggcgatcgggcccagattgttcgcattgagtgcggcccggaggaatatattgccaaggaaatgctctgggactatttggataattttgctgaccatgccctggactatctcaaagaacagcccgaactgcccgatgtcatccatagccattacgccgatgcgggttacgtgggcaccagactttctcaccaattgggtattcctttggtgcacaccggacattccctgggtcgtagtaagcgcacccgtctcctgctcagtgggattaaagccgacgaaattgaaagccgttacaatatggcccgccggattaacgcggaggaagaaaccctaggatcagcggcgagggtgattaccagtacccatcaggaaatcgcagaacagtacgcccaatacgactattaccagccagaccagatgttggttattccccccggcactgatttagaaaagttttatccccccaaagggaacgagtgggaaacgcccattgttcaagagttgcaacgatttctacggcatccccgtaagcctattatcctcgctttgtcccgaccggatccccgcaaaaatatccataaattaattgcagcctatggccagtccccgcagttacaggcccaggccaatttggtcattgtggcgggcaatcgggatgacatcacggatctagaccaggggccgagggaagtactgacggatttactgttgaccattgaccgttacgatctctacggcaaagtggcttaccccaaacagaatcaggcggaggatgtgtatgctttgtttcgcctcactgctttatcccagggagtatttatcaatccggctttgacggaaccctttggtttaactttgattgaagcggcggcctgtggtgtgcccattgtggccacggaggatgggggcccggtggatattatcaaaaattgtcagaatggctatctaattaatcccctcgatgaagtggatattgcggataaattgctcaaagtactaaacgacaaacaacaatggcaattcctttctgaaagtggtctagagggagttaagcgccattattcttggccttcccacgttgaaagttatttagaagccatcaacgctctgacccaacagacttcagtgctgaaacgtagtgatttaaagcggcggcggactttgtactataacggtgccctggttactagtttggaccaaaatttactgggggcattacaggggggattaccgggcgatcgccagacgttggacgaattactggaagtgctgtatcaacatcgaaaaaatgtcggcttttgcattgccactgggagaagattggattcggtgctgaaaattttgcgggagtatcgcattccccaaccggatatgttgatcaccagcatgggcacggaaatttattcttccccggatttgatccccgaccagagttggcgcaatcacattgattatttgtggaaccgtaacgccattgtgcgtattttgggggaattacccggtttagccctccaacccaaggaagaactgagcgcctataaaattagctatttctacgatgcggcgatcgcccctaacctagaagaaattcggcaactgttgcataaaggggaacaaaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttaa

SEQ ID NO: 4 - protein, 720 aa, Synechocystis PCC6803
MSYSSKYILLISVHGLIRGENLELGRDADTGGQTKYVLELARALVKNPQVARVDLLTRLIKDPKVDADYAQPRELIGDRAQIVRIECGPEEYIAKEMLWDYLDNFADHALDYLKEQPELPDVIHSHYADAGYVGTRLSHQLGIPLVHTGHSLGRSKRTRLLLSGIKADEIESRYNMARRINAEEETLGSAARVITSTHQEIAEQYAQYDYYQPDQMLVIPPGTDLEKFYPPKGNEWETPIVQELQRFLRHPRKPIILALSRPDPRKNIHKLIAAYGQSPQLQAQANLVIVAGNRDDITDLDQGPREVLTDLLLTIDRYDLYGKVAYPKQNQAEDVYALFRLTALSQGVFINPALTEPFGLTLIEAAACGVPIVATEDGGPVDIIKNCQNGYLINPLDEVDIADKLLKVLNDKQQWQFLSESGLEGVKRHYSWPSHVESYLEAINALTQQTSVLKRSDLKRRRTLYYNGALVTSLDQNLLGALQGGLPGDRQTLDELLEVLYQHRKNVGFCIATGRRLDSVLKILREYRIPQPDMLITSMGTEIYSSPDLIPDQSWRNHIDYLWNRNAIVRILGELPGLALQPKEELSAYKISYFYDAAIAPNLEEIRQLLHKGEQTVNTIISFGQFLDILPIRASKGYAVRWLSQQWNIPLEHVFTAGGSGADEDMMRGNTLSVVVANRHHEELSNLGEIEPIYFSEKRYAAGILDGLAHYRFFELLDPV

SEQ ID NO: 5 - DNA, 735 bp, Synechocystis PCC6803
atgcgacagttattgctaatttctgacctggacaatacctgggtcggagatcaacaagccctggaacatttgcaagaatatctaggcgatcgccggggaaatttttatttggcctatgccacggggcgttcctaccattccgcgagggagttgcaaaaacaggtgggactcatggaaccggactattggctcaccgcggtggggagtgaaatttaccatccagaaggcctggaccaacattgggctgattacctctctgagcattggcaacgggatatcctccaggcgatcgccgatggttttgaggccttaaaaccccaatctcccttggaacaaaacccatggaaaattagctatcatctcgatccccaggcttgccccaccgtcatcgaccaattaacggagatgttgaaggaaaccggcatcccggtgcaggtgattttcagcagtggcaaagatgtggatttattgccccaacggagtaacaaaggtaacgccacccaatatctgcaacaacatttagccatggagccgtctcaaaccctggtgtgtggggactccggcaatgatattggcttatttgaaacttccgctcggggtgtcattgtccgtaatgcccagccggaattattgcactggtatgaccaatggggggattctcgtcattatcgggcccaatcgagccatgctggcgctatcctagaggcgatcgcccatttcgattttttgagctga

SEQ ID NO: 6 - protein, 244 aa, Synechocystis PCC6803
MRQLLLISDLDNTWVGDQQALEHLQEYLGDRRGNFYLAYATGRSYHSARELQKQVGLMEPDYWLTAVGSEIYHPEGLDQHWADYLSEHWQRDILQAIADGFEALKPQSPLEQNPWKISYHLDPQACPTVIDQLTEMLKETGIPVQVIFSSGKDVDLLPQRSNKGNATQYLQQHLAMEPSQTLVCGDSGNDIGLFETSARGVIVRNAQPELLHWYDQWGDSRHYRAQSSHAGAILEAIAHFDFLS

SEQ ID NO: 7 - DNA, 28 bp, Artificial
  primer for amplificaiton of asf
agactacaattggggcgttttctgtgag

SEQ ID NO: 8 - DNA, 49 bp, Artificial
  primer for amplificaiton of asf
cttacgtgccgatcaacgtctcattctgaaaaggttaagcgatcgcctc

SEQ ID NO: 9 - DNA, 39 bp, Artificial
  Primer for amplifying cat gene from pBeloBAC11
ttatcgcgatcgtcaggagctaaggaagctaaaatggag

SEQ ID NO: 10 - DNA, 29 bp, Artificial
  primer for amplificaiton of cat
cgaccaattcacgtgtttgacagcttatc

SEQ ID NO: 11 - DNA, 811 bp, Artificial
  cat gene amplified from pBeloBAC11
ttatcgcgatcgtcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacgtgaattggtcg

SEQ ID NO: 12 - DNA, 35 bp, Artificial
  primer for amplifying cat gene bearing the promoter from pBeloBAC11
ttttggcgatcgtgagacgttgatcggcacgtaag

SEQ ID NO: 13 - DNA, 29 bp, Artificial
  primer for amplifying cat gene bearing the promoter from pBeloBAC11
cgaccaattcacgtgtttgacagcttatc

SEQ ID NO: 14 - DNA, 901 bp, Artificial
  cat gene bearing the promoter amplified from pBeloBAC11
ttttggcgatcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacgtgaattggtcg

SEQ ID NO: 15 - DNA, 30 bp, Artificial
  primer for sequence verification of cat/asf
gcttctgcgttctgatttaatctgtatcag

SEQ ID NO: 16 - DNA, 27 bp, Artificial
  primer for sequence verification of cat/asf
tatcacttattcaggcgtagcaaccag

SEQ ID NO: 17 - DNA, 27 bp, Artificial
  primer for sequence verification of cat/asf
gtcgttagtgacatcgacaacacactg

SEQ ID NO: 18 - DNA, 26 bp, Artificial
  primer for sequence verification of cat/asf
gatcgcgatactgatcgagataggtc

SEQ ID NO: 19 - DNA, 10577 bp, Artificial
  Plasmid pLybAL11 containing ASF gene from Synechococcus elongatus PCC 7942
tgcatgcctgcaggtcgactctagaggatccccgggtaccgagctcgaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagct

SEQ ID NO: 20 - DNA, 10667 bp, Artificial
  Plasmid pLybAL12 containing asf gene from Synechococcus elongatus PCC 7942
tgcatgcctgcaggtcgactctagaggatccccgggtaccgagctcgaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagct

SEQ ID NO: 21 - DNA, 28 bp, Artificial
  primer for amplifying Synechocystis spp. PCC 6803 pyrR (SphI/KpnI)
cggtgtgcatgccgttattgatggaatg

SEQ ID NO: 22 - DNA, 32 bp, Artificial
  primer for amplifying Synechocystis spp. PCC 6803 pyrR (SphI/KpnI)
tcactaggtacctaaattacctgggaagccag

SEQ ID NO: 23 - DNA, 474 bp, Synechocystis PCC6803
cggtgtgcatgccgttattgatggaatgggaagaagcaatggtcacaataaactggaggttatgggtatgttttttagccctaatgctccaatcgccttgattgtatcgaatgatgcagtctctaaaattgtatccgtaaaagacctctgcaccgccgacgggtctggattatgggcaataatcacagtcgagccagactacccctggaggtaaactccggggctggagccataaagattaggaattcattaagaaatgtaacaatcgacgttctagatcataccacgcccccactgtccggcagggtgaacagaggagactttcccctgttacagtgtcagtgacaaaacaactttttggcatcggtgcaggtggtgagccatggcggcccagatcattgaaattctttccccggaggaaatccgacgtacccttacccgtctggcttcccaggtaatttaggtacctagtga

SEQ ID NO: 24 - DNA, 35 bp, Artificial
  primer for amplifying Synechocystis spp. PCC 6803 nirA (SphI/KpnI)
cccaaggcatgcaggaaaacaagctcagaatgctg

SEQ ID NO: 25 - DNA, 42 bp, Artificial
  primer for amplifying Synechocystis spp. PCC 6803 nirA (SphI/KpnI)
tttattggtaccaacgcttcaagccagataacagtagagatc

SEQ ID NO: 26 - DNA, 384 bp, Synechocystis PCC6803
cccaaggcatgcaggaaaacaagctcagaatgctgcggggagaagggcaactccccaccagccccaaatttttgctggcgataaatatttttcggtttaattgttcacaaagctttttgaatttgagtttatagaaatttattggctggtaatgcttttttgcccccctgcaggacttcattgatccttgcctataccatcaatatcattggtcaataatgatgatgattgactaaaacatgtttaacaaaatttaacgcatatgctaaatgcgtaaactgcatatgccttggctgagtgtaatttacgttacaaattttaacgaaacgggaaccctatattgatctctactgttatctggcttgaagcgttggtaccaataaa

SEQ ID NO: 27 - DNA, 26 bp, Artificial
  primer for amplifying Synechococcus elongatus PCC 7942 psbAII (SphI/KpnI)
atctttgcgttccgtgacggctactg

SEQ ID NO: 28 - DNA, 25 bp, Artificial
  primer for amplifying Synechococcus elongatus PCC 7942 psbAII (SphI/KpnI)
gcagatggtaccggtcagcagagtg

SEQ ID NO: 29 - DNA, 676 bp, Synechococcus PCC7942
atctttgcgttccgtgacggctactgccagcatgccgagcctgatgtgtgacacctaagatcactccagttctctttggaaactggctgatgagtgaagacaccatctttggcaagatcatccggcgcgagattccagcagacattgtttatgaagatgatctctgtctggcttttcgagatgtggcaccccaagcgccggttcacattctggtgattcccaagcaaccaattgccaaccttttggaagcgacagcagaacatcaagcgctgctgggtcatttgttgctgactgtaaaggcgatcgcggcccaagaaggactcaccgagggctaccgcaccgtgattaacacgggccctgcgggtgggcaaaccgtttaccacctgcatattcacttactgggcgggcgatcgctggcttggccgcccggctgagaaaagtctgaaagttctttacaaaactcaatctgcttgttagattttactcacgaggctattaagtctcgtaaatagttcaactaaggactcatcgcaaaatgacgactgcattgcagcggcgcgagagcgccagcctgtggcagcagttctgcgagtgggtaaccagcaccgacaaccgcctctatgtgggttggttcggcgtgctgatgatccccactctgctgaccggtaccatctgc

SEQ ID NO: 30 - DNA, 40 bp, Artificial
  primer for amplifying Synechococcus elongatus PCC 7942 nirA
cagccagcatgcataaatttctgttttgaccaaaccatcc

SEQ ID NO: 31 - DNA, 34 bp, Artificial
  primer for amplifying Synechococcus elongatus PCC 7942 nirA
gtggctggtaccatggattcatctgcctacaaag

SEQ ID NO: 32 - DNA, 579 bp, Synechococcus PCC7942
cagccagcatgcataaatttctgttttgaccaaaccatcccgacataactcggtcagggcttgcaaaacagcggggatgcgatcgtgctgccagagactgcaaaggtgagccaataaccactgcgtctgccagtcatcaggtatcgcttggcagcgctgcaacccagcttcgaggacgcgaacatcaactgttttggccagttgctgaacctgtcgccaacaatgttcaaaatcaccgcttggccagccgtcactctctgcaaacgctgcatcagtcatgtgcaatcaatacaggttaaaaaccatgctaatggctccacctaagcgggcttcagagtcaaggcttgtagcaattgctactaaaaactgcgatcgctgctgaaatgagctggaattctgtccctctcagctcaaaaagtatcaatgattacttaatgtttgttctgcgcaaacttcttgcagaacatgcatgatttacaaaaagttgtagtttctgttaccaattgcgaatcgagaactgcctaatctgccgagtatgcaagctgctttgtaggcagatgaatccatggtaccagccac

SEQ ID NO: 33 - DNA, 35 bp, Artificial
  primer for amplifying gammaPR (XbaI/KpnI)
gtgcattctagatggctacgagggcagacagtaag

SEQ ID NO: 34 - DNA, 50 bp, Artificial
  primer for amplifying gammaPR (XbaI/KpnI)
ttctgtggtaccatatggatcctccttcttaagatgcaaccattatcacc

SEQ ID NO: 35 - DNA, 1186 bp, Artificial
  gammaPR (XbaI/KpnI) promoter
gtgcattctagatggctacgagggcagacagtaagtggatttaccataatcccttaattgtacgcaccgctaaaacgcgttcagcgcgatcacggcagcagacaggtaaaaatggcaacaaaccaccctaaaaactgcgcgatcgcgcctgataaattttaaccgtatgaatacctatgcaaccagagggtacaggccacattacccccacttaatccactgaagctgccatttttcatggtttcaccatcccagcgaagggccatgcatgcatcgaaattaatacgacgaaattaatacgactcactatagggcaattgttatcagctatgcgccgaccagaacaccttgccgatcagccaaacgtctcttcaggccactgactagcgataactttccccacaacggaacaactctcactgcatgggatcattgggtactgtgggtttagtggttgtaaaaacacctgaccgctatccctgatcagtttcttgaaggtaaactcatcacccccaagtctggctatgcagaaatcacctggctcaacagcctgctcagggtcaacgagaattaacattccgtcaggaaagcttggcttggagcctgttggtgcggtcatggaattaccttcaacctcaagccagaatgcagaatcactggctttcttggttgtgcttacccatctctccgcatcacctttggtaaaggttctaagcttaggtgagaacatccctgcctgaacatgagaaaaaacagggtactcatactcacttctaagtgacggctgcatactaaccgcttcatacatctcgtagatttctctggcgattgaagggctaaattcttcaacgctaactttgagaatttttgtaagcaatgcggcgttataagcatttaatgcattgatgccattaaataaagcaccaacgcctgactgccccatccccatcttgtctgcgacagattcctgggataagccaagttcatttttctttttttcataaattgctttaaggcgacgtgcgtcctcaagctgctcttgtgttaatggtttcttttttgtgctcatacgttaaatctatcaccgcaagggataaatatctaacaccgtgcgtgttgactattttacctctggcggtgataatggttgcatcttaagaaggaggatccatatggtaccacagaa

SEQ ID NO: 36 - DNA, 31 bp, Artificial
  primer for amplifying Synechocystis spp. PCC 6803 dnaK (SphI/KpnI)
gccccagcatgcaccagtaaacataaatctc

SEQ ID NO: 37 - DNA, 30 bp, Artificial
  primer for amplifying Synechocystis spp. PCC 6803 dnaK (SphI/KpnI)
attggtggtaccgaggtcaatcccaacaac

SEQ ID NO: 38 - DNA, 895 bp, Synechocystis PCC6803
gccccagcatgcaccagtaaacataaatctccccggcgacgcaaaaaacgggtgaccatcaagccggtgcgcttcggcatttttctgctttgcctagcaggcattgtggggggggcaactgccctaattatcaatcgtactggcgatcccctaggtgggttgctagaagaccccctagatgttttcctggaccaaccttcagaatttatccccgatgaagccacgagccggaatttgattctcagtcaacccaacttcaatcagcaagtgggtcagatggtagtacaaggctggcttgatagtaaaaagttagcctttggccaaaactacgatgtcggggcattgcagagtgttttagcccccaatctccttgcccaacaacggggtcgggcccaacgggatcaagcccaaaaggtctatcaccaatacgaacacaagttgcagattttagcctatcaagttaacccccaagaccccaaccgagccaccgttactgcccgggtagaagaaattagccagccctttaccctaggtaatcaacagcagaagggctccgccaccaaagatgacttgactgtgcgctatcagctagtacgacaccaaggggtttggaaaattgaccaaatacaagtggtaaatggcccccgttagtgcgtggcgttaactccccttttgaccaatggcatacggctagatgcccccataggtacggaaacctgcacttccgagaactaagcccctaccgtcactataagagtgtgaacgtgtcggccccaggcaatggattggaaccatggcttttcggcccatcgttgtgtcttatattcttacttgttaacgggagttaattaaaattatgggaaaagttgttgggattgacctcggtaccaccaat

SEQ ID NO: 39 - DNA, 28 bp, Artificial
  primer for amplifying Synechocystis spp. PCC 6803 kiaA (SphI/KpnI)
gccagagcatgcaaagctcactaactgg

SEQ ID NO: 40 - DNA, 31 bp, Artificial
  primer for amplifying Synechocystis spp. PCC 6803 kiaA (SphI/KpnI)
ggaaaaggtacctgagtctatgggcaacgtg

SEQ ID NO: 41 - DNA, 603 bp, Synechocystis PCC6803
gccagagcatgcaaagctcactaactgggcgggattttccgggtccggttgctgacggtaatagtcgtctaaaagtttggccacatccaaaaggctgtcggcggggggatgctggccggcgaggggattaattctgcttgtcatatacaaaaattgtaaaaaatggagggcggcgatcaggggcttagacacccaaatcctagccaaaaagggttaactagccaagggctatccatgggcaaagagataaaagaaaaagtctccaaatccctggtcatagagaaaaaattgccaaagttaccccaggccatacacggcccagcgccaagatggggagcacaaattcaaactttgtaaacaggccggaagctatccggccaaggagcactcagattgtgttaacgttcaggggagttgcttaacacaattttccaattaatagtattaatattttcttaacttgcaccgtaccatggtgagaaagcctatctgagcccttatttgattaaccttcgactgattattgatcccctgtgcagtctcccctctccctctgtctttttgctcccgaacacgttgcccatagactcaggtaccttttcc

SEQ ID NO: 42 - DNA, 30 bp, Artificial; identical to SEQ ID NO: 15
  primer for sequence analysis of pLybAL

SEQ ID NO: 43 - DNA, 27 bp, Artificial
  primer for sequence analysis of pLybAL
atgggtctgaatgtgcagaatgtagag

SEQ ID NO: 44 - DNA, 11090 bp, Artificial
  plasmid pLybAL15
tgcatgccgttattgatggaatgggaagaagcaatggtcacaataaactggaggttatgggtatgttttttagccctaatgctccaatcgccttgattgtatcgaatgatgcagtctctaaaattgtatccgtaaaagacctctgcaccgccgacgggtctggattatgggcaataatcacagtcgagccagactacccctggaggtaaactccggggctggagccataaagattaggaattcattaagaaatgtaacaatcgacgttctagatcataccacgcccccactgtccggcagggtgaacagaggagactttcccctgttacagtgtcagtgacaaaacaactttttggcatcggtgcaggtggtgagccatggcggcccagatcattgaaattctttccccggaggaaatccgacgtacccttacccgtctggcttcccaggtaatttaggtaccgagctcgaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagct

SEQ ID NO: 45 - DNA, 11000 bp, Artificial
  plasmid pLybAL16
tgcatgcaggaaaacaagctcagaatgctgcggggagaagggcaactccccaccagccccaaatttttgctggcgataaatatttttcggtttaattgttcacaaagctttttgaatttgagtttatagaaatttattggctggtaatgcttttttgcccccctgcaggacttcattgatccttgcctataccatcaatatcattggtcaataatgatgatgattgactaaaacatgtttaacaaaatttaacgcatatgctaaatgcgtaaactgcatatgccttggctgagtgtaatttacgttacaaattttaacgaaacgggaaccctatattgatctctactgttatctggcttgaagcgttggtaccgagctcgaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagct

SEQ ID NO: 46 - DNA, 11269 bp, Artificial
  plasmid pLybAL17
tgcatgccgagcctgatgtgtgacacctaagatcactccagttctctttggaaactggctgatgagtgaagacaccatctttggcaagatcatccggcgcgagattccagcagacattgtttatgaagatgatctctgtctggcttttcgagatgtggcaccccaagcgccggttcacattctggtgattcccaagcaaccaattgccaaccttttggaagcgacagcagaacatcaagcgctgctgggtcatttgttgctgactgtaaaggcgatcgcggcccaagaaggactcaccgagggctaccgcaccgtgattaacacgggccctgcgggtgggcaaaccgtttaccacctgcatattcacttactgggcgggcgatcgctggcttggccgcccggctgagaaaagtctgaaagttctttacaaaactcaatctgcttgttagattttactcacgaggctattaagtctcgtaaatagttcaactaaggactcatcgcaaaatgacgactgcattgcagcggcgcgagagcgccagcctgtggcagcagttctgcgagtgggtaaccagcaccgacaaccgcctctatgtgggttggttcggcgtgctgatgatccccactctgctgaccggtaccgagctcgaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagct

SEQ ID NO: 47 - DNA, 11195 bp, Artificial
  plasmid pLybAL18
tgcatgcataaatttctgttttgaccaaaccatcccgacataactcggtcagggcttgcaaaacagcggggatgcgatcgtgctgccagagactgcaaaggtgagccaataaccactgcgtctgccagtcatcaggtatcgcttggcagcgctgcaacccagcttcgaggacgcgaacatcaactgttttggccagttgctgaacctgtcgccaacaatgttcaaaatcaccgcttggccagccgtcactctctgcaaacgctgcatcagtcatgtgcaatcaatacaggttaaaaaccatgctaatggctccacctaagcgggcttcagagtcaaggcttgtagcaattgctactaaaaactgcgatcgctgctgaaatgagctggaattctgtccctctcagctcaaaaagtatcaatgattacttaatgtttgttctgcgcaaacttcttgcagaacatgcatgatttacaaaaagttgtagtttctgttaccaattgcgaatcgagaactgcctaatctgccgagtatgcaagctgctttgtaggcagatgaatccatggtaccgagctcgaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagct

SEQ ID NO: 48 - DNA, 11820 bp, Artificial
  plasmid pLybAL19
tgcatgcctgcaggtcgactctagatggctacgagggcagacagtaagtggatttaccataatcccttaattgtacgcaccgctaaaacgcgttcagcgcgatcacggcagcagacaggtaaaaatggcaacaaaccaccctaaaaactgcgcgatcgcgcctgataaattttaaccgtatgaatacctatgcaaccagagggtacaggccacattacccccacttaatccactgaagctgccatttttcatggtttcaccatcccagcgaagggccatgcatgcatcgaaattaatacgacgaaattaatacgactcactatagggcaattgttatcagctatgcgccgaccagaacaccttgccgatcagccaaacgtctcttcaggccactgactagcgataactttccccacaacggaacaactctcactgcatgggatcattgggtactgtgggtttagtggttgtaaaaacacctgaccgctatccctgatcagtttcttgaaggtaaactcatcacccccaagtctggctatgcagaaatcacctggctcaacagcctgctcagggtcaacgagaattaacattccgtcaggaaagcttggcttggagcctgttggtgcggtcatggaattaccttcaacctcaagccagaatgcagaatcactggctttcttggttgtgcttacccatctctccgcatcacctttggtaaaggttctaagcttaggtgagaacatccctgcctgaacatgagaaaaaacagggtactcatactcacttctaagtgacggctgcatactaaccgcttcatacatctcgtagatttctctggcgattgaagggctaaattcttcaacgctaactttgagaatttttgtaagcaatgcggcgttataagcatttaatgcattgatgccattaaataaagcaccaacgcctgactgccccatccccatcttgtctgcgacagattcctgggataagccaagttcatttttctttttttcataaattgctttaaggcgacgtgcgtcctcaagctgctcttgtgttaatggtttcttttttgtgctcatacgttaaatctatcaccgcaagggataaatatctaacaccgtgcgtgttgactattttacctctggcggtgataatggttgcatcttaagaaggaggatccatatggtaccgagctcgaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagct

SEQ ID NO: 49 - DNA, 11511 bp, Artificial
  plasmid pLybAL21
tgcatgcaccagtaaacataaatctccccggcgacgcaaaaaacgggtgaccatcaagccggtgcgcttcggcatttttctgctttgcctagcaggcattgtggggggggcaactgccctaattatcaatcgtactggcgatcccctaggtgggttgctagaagaccccctagatgttttcctggaccaaccttcagaatttatccccgatgaagccacgagccggaatttgattctcagtcaacccaacttcaatcagcaagtgggtcagatggtagtacaaggctggcttgatagtaaaaagttagcctttggccaaaactacgatgtcggggcattgcagagtgttttagcccccaatctccttgcccaacaacggggtcgggcccaacgggatcaagcccaaaaggtctatcaccaatacgaacacaagttgcagattttagcctatcaagttaacccccaagaccccaaccgagccaccgttactgcccgggtagaagaaattagccagccctttaccctaggtaatcaacagcagaagggctccgccaccaaagatgacttgactgtgcgctatcagctagtacgacaccaaggggtttggaaaattgaccaaatacaagtggtaaatggcccccgttagtgcgtggcgttaactccccttttgaccaatggcatacggctagatgcccccataggtacggaaacctgcacttccgagaactaagcccctaccgtcactataagagtgtgaacgtgtcggccccaggcaatggattggaaccatggcttttcggcccatcgttgtgtcttatattcttacttgttaacgggagttaattaaaattatgggaaaagttgttgggattgacctcggtaccgagctcgaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagct

SEQ ID NO: 50 - DNA, 11219 bp, Artificial
  plasmid pLybAL22
tgcatgcaaagctcactaactgggcgggattttccgggtccggttgctgacggtaatagtcgtctaaaagtttggccacatccaaaaggctgtcggcggggggatgctggccggcgaggggattaattctgcttgtcatatacaaaaattgtaaaaaatggagggcggcgatcaggggcttagacacccaaatcctagccaaaaagggttaactagccaagggctatccatgggcaaagagataaaagaaaaagtctccaaatccctggtcatagagaaaaaattgccaaagttaccccaggccatacacggcccagcgccaagatggggagcacaaattcaaactttgtaaacaggccggaagctatccggccaaggagcactcagattgtgttaacgttcaggggagttgcttaacacaattttccaattaatagtattaatattttcttaacttgcaccgtaccatggtgagaaagcctatctgagcccttatttgattaaccttcgactgattattgatcccctgtgcagtctcccctctccctctgtctttttgctcccgaacacgttgcccatagactcaggtaccgagctcgaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaaaggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagct

SEQ ID NO: 51 - DNA, 4962 bp, Artificial
  plasmid pLybAL13f
cgaccaattcacgtgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgacgttctgaaaaggttaagcgatcgcctcaaaaaagcgatagtgttttaaggcttccagaatgccattagcatagtggccctcagcaaaatagacgcgctcgtagctgcgcagtggctccaattccggtgagtaattgccaactacaacgccgagattatggcccttgagcatttcctcatcgttaccagaatcgcctgccaccaaaatgttctcaagaggaatccgccagcggagtgagaggtggcgaatcgcatcccctttcgaggcagctagcggcagaatgtcaagaaactcctgatgggaatagattgacttcagccgcaggcgatggcggcgaagatgttgccgtacttctcgcagcacagtctcgtggcgatcgcggacaaagaagctgactttgaagggtgtttgatcctcttccggctgcagttcaagaaagggtagttgtgccattactgcccgaattcgctgaggattccagttgcgattgatatgcttttcccagctgatatccggttcagcatcggtgccatagtgaatctcgctgccgacggaagtcacccagaagtttggcgaaggaacgccccactctttcaagacttcttgggcagagtctaggcgacgccccgtggcaattccaaaggcaaaatgatcgcgatactgatcgagataggtcattaaattctcgagtccttgacgatcgcccaacagtgtgttgtcgatgtcactaacgacaaggcgtttggcatcaatcaagcgtttgcgactccgtacgaaactgacagcacgacgacgaggcaaagccaccgtttccatgcgctcaaacagggtattgacatgttgatcccagctgtaatgggcgggaactttttcaatgccattgcggtgatagcactgccaaagatcgcgatcgctcagcagggtggcgagtgcagtcgcgatattagcgggtcggctgacatcaactaaagtgccgaaatcacagtgtttgagaatttcctgggggccgccatcatgggttgccaccaccggcacgccgcagcttcctgcctccaaaattgtcaaaccaaaaggttcggtcagcgccggattgacgaataccccgccggaatgagccgctaggcgatagaactccggcacatcatcagcctgatgctgtttgggataggcgacgctgccgtagaggtcgtagcgatcgaccagatggaaaatctcttggaacacctgccgactgccgcgatccatctggttgatgtcttggcggctgcccagtactaagacaaggttggcttttttgcgcagccaaggatgttcgccaaaggctcgcaccagcgccggtacatttttgcgaggtgcggggcgacagaggcagagaatttgaggtttttctgggtcgcgcagaaagcggctcagttcctgttggagaacaacaccgcgatcgcccaagggctgaaacctgaagcgatcggtatcgacacccggtggaatgacaagcttgcgctctgggttgtagcgatcgtaaacgcggtattgctcctccacttcctgctgagtgctggcgacaatccagtcagcatgagtgagcgtcatctcctccgcatcaattcgctgttgaatattgaattgcgcttcaatttcctcaagcggccagtcttgctccaacagcttttttagcttgatccgccccagagaatgccctgtgaaaattagcggtacattcaaccagcgactcagcagtgatcccacttggccagcatcagcatagtgggcctgaatccaagtcggggtgcgcttttgctgagccagatattggagaattgcatccgcaaaggtgtagagatggggccaaagcagctctttacggaggtagcgtttggggccaaaaggcaaacggacaatccgacctttgggcgcaaagggttcgatcgcctgactgtaaccaacactgacgcgggggtcggtgatttggcgggtgatgatgtcgacttgttggacttgtggggatttagcttgggcttgagccagttctaagacgtacttggtctgcccgccggtgtcggcatctcgccccagttccaagttctgccctcgcagcagaccatgggtctgaatgtgcagaatgtagagattttgagctgccacgcgctagtcagcctcacagaaaacgccccaattgtagtctaacgaattcaagcttgatatcattcaggacgagcctcagactccagcgtaactggactgcaatcaactcactggctcaccttcacgggtgggcctttcttcggtagaaaatcaaaggatcttcttgagatcctttttttctgcgcgtaatctgctgcttgcaaacaaaaaaaccaccgctaccagcggtggtttgtttgccggatcaagagctaccaactctttttccgaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcatcgatttttgtgatgctcgtcaggggggcggagcctatggaaaaacgccagcaacgcagaaaggcccacccgaaggtgagccaggtgattacatttgggccctcatcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcatttagaaaaactcatcgagcatcaagtgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcaccaaccaaaccgttattcattcgtgattgcgcctgagcgagacgaaatacgcgatcgccgttaaaaggacaattacaaacaggaatcgaatgcaaccggcgcaggaacactgccagcgcatcaacaatattttcacctgaatcaggatattcttctaatacctggaatgctgttttccctgggatcgcagtggtgagtaaccatgcatcatcaggagtacggataaaatgcttgatggtcggaagaggcataaattccgtcagccagtttagcctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcattttagcttccttagctcctgaaaatctcgataactcaaaaaatacgcccggtagtgatcttatttcattatggtgaaagttggaacctcttacgtgccgatcaagtcaaaagcctccggtcggaggcttttgactttctgctatggaggtcaggtatgatttaaatggtcagtattgagcgatatctagagaattcgtc

SEQ ID NO: 52 - DNA, 4962 bp, Artificial
  plasmid pLybAL13r
agactacaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaacgtcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacgtgaattggtcgaacgaattcaagcttgatatcattcaggacgagcctcagactccagcgtaactggactgcaatcaactcactggctcaccttcacgggtgggcctttcttcggtagaaaatcaaaggatcttcttgagatcctttttttctgcgcgtaatctgctgcttgcaaacaaaaaaaccaccgctaccagcggtggtttgtttgccggatcaagagctaccaactctttttccgaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcatcgatttttgtgatgctcgtcaggggggcggagcctatggaaaaacgccagcaacgcagaaaggcccacccgaaggtgagccaggtgattacatttgggccctcatcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcatttagaaaaactcatcgagcatcaagtgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcaccaaccaaaccgttattcattcgtgattgcgcctgagcgagacgaaatacgcgatcgccgttaaaaggacaattacaaacaggaatcgaatgcaaccggcgcaggaacactgccagcgcatcaacaatattttcacctgaatcaggatattcttctaatacctggaatgctgttttccctgggatcgcagtggtgagtaaccatgcatcatcaggagtacggataaaatgcttgatggtcggaagaggcataaattccgtcagccagtttagcctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcattttagcttccttagctcctgaaaatctcgataactcaaaaaatacgcccggtagtgatcttatttcattatggtgaaagttggaacctcttacgtgccgatcaagtcaaaagcctccggtcggaggcttttgactttctgctatggaggtcaggtatgatttaaatggtcagtattgagcgatatctagagaattcgtc

SEQ ID NO: 53 - DNA, 5052 bp, Artificial
  plasmid pLybAL14f
cgaccaattcacgtgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcacgttctgaaaaggttaagcgatcgcctcaaaaaagcgatagtgttttaaggcttccagaatgccattagcatagtggccctcagcaaaatagacgcgctcgtagctgcgcagtggctccaattccggtgagtaattgccaactacaacgccgagattatggcccttgagcatttcctcatcgttaccagaatcgcctgccaccaaaatgttctcaagaggaatccgccagcggagtgagaggtggcgaatcgcatcccctttcgaggcagctagcggcagaatgtcaagaaactcctgatgggaatagattgacttcagccgcaggcgatggcggcgaagatgttgccgtacttctcgcagcacagtctcgtggcgatcgcggacaaagaagctgactttgaagggtgtttgatcctcttccggctgcagttcaagaaagggtagttgtgccattactgcccgaattcgctgaggattccagttgcgattgatatgcttttcccagctgatatccggttcagcatcggtgccatagtgaatctcgctgccgacggaagtcacccagaagtttggcgaaggaacgccccactctttcaagacttcttgggcagagtctaggcgacgccccgtggcaattccaaaggcaaaatgatcgcgatactgatcgagataggtcattaaattctcgagtccttgacgatcgcccaacagtgtgttgtcgatgtcactaacgacaaggcgtttggcatcaatcaagcgtttgcgactccgtacgaaactgacagcacgacgacgaggcaaagccaccgtttccatgcgctcaaacagggtattgacatgttgatcccagctgtaatgggcgggaactttttcaatgccattgcggtgatagcactgccaaagatcgcgatcgctcagcagggtggcgagtgcagtcgcgatattagcgggtcggctgacatcaactaaagtgccgaaatcacagtgtttgagaatttcctgggggccgccatcatgggttgccaccaccggcacgccgcagcttcctgcctccaaaattgtcaaaccaaaaggttcggtcagcgccggattgacgaataccccgccggaatgagccgctaggcgatagaactccggcacatcatcagcctgatgctgtttgggataggcgacgctgccgtagaggtcgtagcgatcgaccagatggaaaatctcttggaacacctgccgactgccgcgatccatctggttgatgtcttggcggctgcccagtactaagacaaggttggcttttttgcgcagccaaggatgttcgccaaaggctcgcaccagcgccggtacatttttgcgaggtgcggggcgacagaggcagagaatttgaggtttttctgggtcgcgcagaaagcggctcagttcctgttggagaacaacaccgcgatcgcccaagggctgaaacctgaagcgatcggtatcgacacccggtggaatgacaagcttgcgctctgggttgtagcgatcgtaaacgcggtattgctcctccacttcctgctgagtgctggcgacaatccagtcagcatgagtgagcgtcatctcctccgcatcaattcgctgttgaatattgaattgcgcttcaatttcctcaagcggccagtcttgctccaacagcttttttagcttgatccgccccagagaatgccctgtgaaaattagcggtacattcaaccagcgactcagcagtgatcccacttggccagcatcagcatagtgggcctgaatccaagtcggggtgcgcttttgctgagccagatattggagaattgcatccgcaaaggtgtagagatggggccaaagcagctctttacggaggtagcgtttggggccaaaaggcaaacggacaatccgacctttgggcgcaaagggttcgatcgcctgactgtaaccaacactgacgcgggggtcggtgatttggcgggtgatgatgtcgacttgttggacttgtggggatttagcttgggcttgagccagttctaagacgtacttggtctgcccgccggtgtcggcatctcgccccagttccaagttctgccctcgcagcagaccatgggtctgaatgtgcagaatgtagagattttgagctgccacgcgctagtcagcctcacagaaaacgccccaattgtagtctaacgaattcaagcttgatatcattcaggacgagcctcagactccagcgtaactggactgcaatcaactcactggctcaccttcacgggtgggcctttcttcggtagaaaatcaaaggatcttcttgagatcctttttttctgcgcgtaatctgctgcttgcaaacaaaaaaaccaccgctaccagcggtggtttgtttgccggatcaagagctaccaactctttttccgaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcatcgatttttgtgatgctcgtcaggggggcggagcctatggaaaaacgccagcaacgcagaaaggcccacccgaaggtgagccaggtgattacatttgggccctcatcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcatttagaaaaactcatcgagcatcaagtgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcaccaaccaaaccgttattcattcgtgattgcgcctgagcgagacgaaatacgcgatcgccgttaaaaggacaattacaaacaggaatcgaatgcaaccggcgcaggaacactgccagcgcatcaacaatattttcacctgaatcaggatattcttctaatacctggaatgctgttttccctgggatcgcagtggtgagtaaccatgcatcatcaggagtacggataaaatgcttgatggtcggaagaggcataaattccgtcagccagtttagcctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcattttagcttccttagctcctgaaaatctcgataactcaaaaaatacgcccggtagtgatcttatttcattatggtgaaagttggaacctcttacgtgccgatcaagtcaaaagcctccggtcggaggcttttgactttctgctatggaggtcaggtatgatttaaatggtcagtattgagcgatatctagagaattcgtc

SEQ ID NO: 54 - DNA, 5052 bp, Artificial
  plasmid pLybAL14r
agactacaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaacgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacgtgaattggtcgaacgaattcaagcttgatatcattcaggacgagcctcagactccagcgtaactggactgcaatcaactcactggctcaccttcacgggtgggcctttcttcggtagaaaatcaaaggatcttcttgagatcctttttttctgcgcgtaatctgctgcttgcaaacaaaaaaaccaccgctaccagcggtggtttgtttgccggatcaagagctaccaactctttttccgaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcatcgatttttgtgatgctcgtcaggggggcggagcctatggaaaaacgccagcaacgcagaaaggcccacccgaaggtgagccaggtgattacatttgggccctcatcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcatttagaaaaactcatcgagcatcaagtgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcaccaaccaaaccgttattcattcgtgattgcgcctgagcgagacgaaatacgcgatcgccgttaaaaggacaattacaaacaggaatcgaatgcaaccggcgcaggaacactgccagcgcatcaacaatattttcacctgaatcaggatattcttctaatacctggaatgctgttttccctgggatcgcagtggtgagtaaccatgcatcatcaggagtacggataaaatgcttgatggtcggaagaggcataaattccgtcagccagtttagcctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcattttagcttccttagctcctgaaaatctcgataactcaaaaaatacgcccggtagtgatcttatttcattatggtgaaagttggaacctcttacgtgccgatcaagtcaaaagcctccggtcggaggcttttgactttctgctatggaggtcaggtatgatttaaatggtcagtattgagcgatatctagagaattcgtc

SEQ ID NO: 55 - DNA, 24 bp, Artificial
  primer for detection of plasmid in cyanobacteria
ggtggttgtgtttgacagcttatc

SEQ ID NO: 56 - DNA, 651 bp, Synechocystis PCC6803
atggcttctcaattacgtgtttatgtgccggagcatcctctaattaagcattggttgggggtagctagggatgaaaacacgccgccggttttgtttaaaactgccatgggggaattgggacgttggttgacctatgaggccgctcgttattggttgccgacggtggatacggaagtgaaaactcccctggcgatcgccaaggccagtcttattgacccccaaacgccctttgtcattgtgcccattttgcgggcggggttggctctggtggaaggggcccaggggttgttgcccctggcaaaaatttaccatctgggtttagtgcgcaatgaaactaccctggaacctagtctgtatctgaacaagttgccggagcggtttgcccccggtacccatcttttgttgctagatcccatgttggctacgggtaataccatcatggctgctttggatttgctgatggcccgggacattgatgccaatttaatccgtttggtctccgtggtggccgcccccactgccctgcaaaaattaagtaatgcccatcccaatttgaccatctacaccgccatgattgacgaacaactcaatgaccggggttacattgtgcccggcctaggggatgcaggcgatcgttgctttggtacttga

SEQ ID NO: 57 - protein, 216 aa, Synechocystis PCC6803
MASQLRVYVPEHPLIKHWLGVARDENTPPVLFKTAMGELGRWLTYEAARYWLPTVDTEVKTPLAIAKASLIDPQTPFVIVPILRAGLALVEGAQGLLPLAKIYHLGLVRNETTLEPSLYLNKLPERFAPGTHLLLLDPMLATGNTIMAALDLLMARDIDANLIRLVSVVAAPTALQKLSNAHPNLTIYTAMIDEQLNDRGYIVPGLGDAGDRCFGT

SEQ ID NO: 58 - DNA, 654 bp, Synechococcus PCC7942
atggctcctcaactgcgtatcttcgtgccgccccatcccttaattcggcactggctgggcattgcccgcgatcgccagacgccgacgcctctgtttcgcaccgcgatcgcagagctgggccgctggctcgcctatgaggctgtgcgggaatggctaccaacgattccagcggcggtgcaaactcctcttgcagaaaccccagcggagttcgtcgatttttcgcaacccttggcgatcgtgccgattctgcgcgcaggtctgggtttagtggagtctgtccaacaggttttgccgactgcccgcatttttcacgtgggtctcaagcgggatgaagtcagtcttgaaccgcgctgctacctcaatcacctgccagagcaacttgaagtgaacagtcgcgttctggttctcgacccgatgctggcgacaggtggctcgctgctctatacccttgatttgctgcgcgatcgcggtgtctctgctgagcaagtgcgggtgctttcaattgtggctgccccgccagcgctacaaaaactcagtcaagcctacccggcgttgacgatttacagcgccatcattgatgagcagctgaacgacaaaggctttatcgtgccggggctgggggatgctggcgatcgcctgtttggtactccttga

SEQ ID NO: 59 - protein, 217 aa, Synechococcus PCC7942
MAPQLRIFVPPHPLIRHWLGIARDRQTPTPLFRTAIAELGRWLAYEAVREWLPTIPAAVQTPLAETPAEFVDFSQPLAIVPILRAGLGLVESVQQVLPTARIFHVGLKRDEVSLEPRCYLNHLPEQLEVNSRVLVLDPMLATGGSLLYTLDLLRDRGVSAEQVRVLSIVAAPPALQKLSQAYPALTIYSAIIDEQLNDKGFIVPGLGDAGDRLFGTP

SEQ ID NO: 60 - DNA, 33 bp, Artificial
  primer for amplifying upp gene from Bacillus subtilis 168
aagaagcaagacagcgtgtagctgctctgactg

SEQ ID NO: 61 - DNA, 50 bp, Artificial
  primer for amplifying upp gene from Bacillus subtilis 168
tcccgggatttggtaccttattttgttccaaacatgcggtcacccgcatc

SEQ ID NO: 62 - DNA, 849 bp, Bacillus subtilis
aagaagcaagacagcgtgtagctgctctgactgataaatttcctttatataaagaattagattattaagatcctaaaacccgcttgggcttatgcccggcgggttttttgacgatgttcttgaaactcaatgtctttttttgtagaatcaatagaagtgtgtaattgttgatgggacaataaaaaaggagctgaaacacagtatgggaaaggtttatgtatttgatcatcctttaattcagcacaagctgacatatatacggaatgaaaatacaggtacgaaggattttagagagttagtagatgaagtggctacactcatggcatttgaaattacccgcgatcttcctctggaagaagtggatatcaatacaccggttcaggctgcgaaatcgaaagtcatctcagggaaaaaactcggagtggttcctatcctcagagcaggattgggaatggttgacggcattttaaagctgattcctgcggcaaaagtgggacatgtcggcctttaccgtgatccagaaaccttaaaacccgtggaatactatgtcaagcttccttctgatgtggaagagcgtgaattcatcgtggttgacccgatgctcgctacaggcggttccgcagttgaagccattcacagccttaaaaaacgcggtgcgaaaaatatccgtttcatgtgtcttgtagcagcgccggagggtgtggaagaattgcagaagcatcattcggacgttgatatttacattgcggcgctagatgaaaaattaaatgaaaaaggatatattgttccaggtctcggagatgcgggtgaccgcatgtttggaacaaaataaggtaccaaatcccggga

SEQ ID NO: 63 - DNA, 22 bp, Artificial
  primer for sequence verification of pLybAL7f
gtaatacgactcactatagggc

SEQ ID NO: 64 - DNA, 24 bp, Artificial
  primer for sequence verification of pLybAL7f
cacacaggaaacagctatgaccat

SEQ ID NO: 65 - DNA, 8988 bp, Artificial
  plasmid pLybAL7f
gcggccgcaaggggttcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcagctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcccactcccgggatttggtaccttattttgttccaaacatgcggtcacccgcatctccgagacctggaacaatatatcctttttcatttaatttttcatctagcgccgcaatgtaaatatcaacgtccgaatgatgcttctgcaattcttccacaccctccggcgctgctacaagacacatgaaacggatatttttcgcaccgcgttttttaaggctgtgaatggcttcaactgcggaaccgcctgtagcgagcatcgggtcaaccacgatgaattcacgctcttccacatcagaaggaagcttgacatagtattccacgggttttaaggtttctggatcacggtaaaggccgacatgtcccacttttgccgcaggaatcagctttaaaatgccgtcaaccattcccaatcctgctctgaggataggaaccactccgagttttttccctgagatgactttcgatttcgcagcctgaaccggtgtattgatatccacttcttccagaggaagatcgcgggtaatttcaaatgccatgagtgtagccacttcatctactaactctctaaaatccttcgtacctgtattttcattccgtatatatgtcagcttgtgctgaattaaaggatgatcaaatacataaacctttcccatactgtgtttcagctccttttttattgtcccatcaacaattacacacttctattgattctacaaaaaaagacattgagtttcaagaacatcgtcaaaaaacccgccgggcataagcccaagcgggttttaggatcttaataatctaattctttatataaaggaaatttatcagtcagagcagctacacgctgtcttgcttcttgtgggatcctctagagtcgacctgcaggcatgcaagcttgagtattctatagtctcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggtcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtccgagctcatcgctaataacttcgtatagcatacattatacgaagttatattcgat

SEQ ID NO: 66 - DNA, 31 bp, Artificial
  primer for amplifying kanamycin resistance marker vector pLybAA1
gtcagtgcactgctctgccagtgttacaacc

SEQ ID NO: 67 - DNA, 38 bp, Artificial
  primer for amplifying kanamycin resistance marker vector pLybAA1
ctcagtggcgccaaaactcacgttaagggattttggtc

SEQ ID NO: 68 - DNA, 950 bp, Artificial
  kanamycin resistance marker from vector pLybAA1, originally derived from pACYC177
gtcagtgcactgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgaccaaaatcccttaacgtgagttttggcgccactgag

SEQ ID NO: 69 - DNA, 9864 bp, Artificial
  plasmid pLybAL8f (kanamycin resistance marker plus pLybAL7f)
gcggccgcaaggggttcgcgtcagcgggtgttggcgggtgtcggggctggcttaactatgcggcatcagagcagattgtactgagagtgcactgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgaccaaaatcccttaacgtgagttttggcgccattcgccattcagctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcccactcccgggatttggtaccttattttgttccaaacatgcggtcacccgcatctccgagacctggaacaatatatcctttttcatttaatttttcatctagcgccgcaatgtaaatatcaacgtccgaatgatgcttctgcaattcttccacaccctccggcgctgctacaagacacatgaaacggatatttttcgcaccgcgttttttaaggctgtgaatggcttcaactgcggaaccgcctgtagcgagcatcgggtcaaccacgatgaattcacgctcttccacatcagaaggaagcttgacatagtattccacgggttttaaggtttctggatcacggtaaaggccgacatgtcccacttttgccgcaggaatcagctttaaaatgccgtcaaccattcccaatcctgctctgaggataggaaccactccgagttttttccctgagatgactttcgatttcgcagcctgaaccggtgtattgatatccacttcttccagaggaagatcgcgggtaatttcaaatgccatgagtgtagccacttcatctactaactctctaaaatccttcgtacctgtattttcattccgtatatatgtcagcttgtgctgaattaaaggatgatcaaatacataaacctttcccatactgtgtttcagctccttttttattgtcccatcaacaattacacacttctattgattctacaaaaaaagacattgagtttcaagaacatcgtcaaaaaacccgccgggcataagcccaagcgggttttaggatcttaataatctaattctttatataaaggaaatttatcagtcagagcagctacacgctgtcttgcttcttgtgggatcctctagagtcgacctgcaggcatgcaagcttgagtattctatagtctcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggtcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtccgagctcatcgctaataacttcgtatagcatacattatacgaagttatattcgat

SEQ ID NO: 70 - DNA, 1470 bp, Synechocystis PCC6803
atgaaatccccccaggctcaacaaatcctagaccaggcccgccgtttgctctacgaaaaagccatggtcaaaatcaatgggcaatacgtggggacggtggcggccattccccaatcggatcaccatgatttgaactatacggaagttttcattcgggacaatgtgccggtgatgatcttcttgttactgcaaaatgaaacggaaattgtccaaaactttttggaaatttgcctcaccctccaaagtaagggctttcccacctacggcatttttcccactagttttgtggaaacggaaaaccatgaactcaaggcagactatggccaacgggcgatcggtcgagtttgctcggtggatgcgtccctctggtggcctattttggcctattactacgtgcaaagaaccggcaatgaagcctgggctagacaaacccatgtgcaattggggctacaaaagtttttaaacctcattctccatccagtctttcgggatgcacccactttgtttgtgcccgacggggcctttatgattgaccgccccatggatgtgtggggagcgccgttggaaatccaaaccctgctctacggagccctgaaaagtgcggcggggttactgttaatcgacctcaaggcgaagggttattgcagcaataaagaccatccttttgacagcttcacgatggagcagagtcatcaatttaacctgagtgtggattggctcaaaaaactccgcacctatctgctcaagcattattggattaattgcaatattgtccaagctctccgccgccgtcccacggaacagtacggtgaagaagccagcaacgaacataatgtccacacagaaaccattcccaactggctccaggattggctcggcgatcggggaggctatttaatcggcaatatccgcacgggtcgccccgattttcgctttttctccctgggtaattgcttgggggcaattttcgatgtcactagcttggcccagcaacgttcctttttccgtttggtattaaataatcagcgggagttatgtgcccaaatgcccctgaggatttgccatccccccctcaaagatgacgattggcgcagtaaaaccggctttgaccgcaaaaatttaccctggtgctaccacaacgccggccattggccctgtttattttggtttctggtggtggcggtgctccgccatagctgccattccaactacggcacggtggagtatgcggaaatggggaacctaattcgcaataactatgaggtgcttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaa

SEQ ID NO: 71 - protein, 489 aa, Synechocystis PCC6803
MKSPQAQQILDQARRLLYEKAMVKINGQYVGTVAAIPQSDHHDLNYTEVFIRDNVPVMIFLLLQNETEIVQNFLEICLTLQSKGFPTYGIFPTSFVETENHELKADYGQRAIGRVCSVDASLWWPILAYYYVQRTGNEAWARQTHVQLGLQKFLNLILHPVFRDAPTLFVPDGAFMIDRPMDVWGAPLEIQTLLYGALKSAAGLLLIDLKAKGYCSNKDHPFDSFTMEQSHQFNLSVDWLKKLRTYLLKHYWINCNIVQALRRRPTEQYGEEASNEHNVHTETIPNWLQDWLGDRGGYLIGNIRTGRPDFRFFSLGNCLGAIFDVTSLAQQRSFFRLVLNNQRELCAQMPLRICHPPLKDDDWRSKTGFDRKNLPWCYHNAGHWPCLFWFLVVAVLRHSCHSNYGTVEYAEMGNLIRNNYEVLLRRLPKHKWAEYFDGPTGFWVGQQSRSYQTWTIVGLLLVHHFTEVNPDDALMFDLPSLKSLHQALH

SEQ ID NO: 72 - DNA, 1392 bp, Synechococcus PCC7942
atgcccgattctgttgtgctgcccgctacgctgcagaccgcgctgcaaacagcggagcagttactttgggatcgggccttggttcgctatcacgatcagtgggcgggggcgatcgcggcactgcctgaagatcaggagttggcggcagcgaactaccgcgaaatctttattcgcgacaacgtgccggtgatgctctacctgctgttgcagggcaaaactgacgttgtccgcgacttcttgcaactgtcgctttctctccagagccaggcactgcaaacctatggcattctgccgaccagtttcgtctgtgaggaaacccactgcgttgctgactatggtcagcgggcgatcgggcgggtggtttctgctgaccctagcctttggtggccggtgctgctacaggcctatcggcgggcctcccatgatgatgcctttgtccacagtccgactgttcagcaggggttacagcggttgctggctttcctgctgcgtccggttttcaaccaaaacccactgctcgaggtgcccgatggggccttcatggtcgatcgtcccttggatgtggcgggcgcacctttagaaattcaagtcctgctctacggggcactgcgggcttgtgggcagttgctgcaatacaccgaagcggccaatgctgcccatgtgcaagcccgtcgcctgcggcagtatctctgctggcactactgggtgacgcccgatcgcctgcgacgctggcagcagtggcccaccgaagaatttggcgatcgcagccataacccctacaacattcagccgatcgccatccctgactgggttgaaccttggctgggtgagtcgggtggctacttcctagggaacatacgggcaggacgtcctgacttccgcttttttagccttggcaatttgctggcgatcgttttcgatgtgcttccgctcaatcagcagggtgcgattctgcgcttgattttgcagaacgaagcccagattttgggccaagtgccgttgcggctctgctatcccgctttaaccggatcggcgtggaaaatcctgacgggttgcgatcctaaaaatcagccttggtcctatcacaacggtggtagttggccatccctgctttggtatctcagtgcggcggtcttgcactaccaacagcggggaggcgatcgcaatctctgtcaggtctggctgaataagcttcagcactaccacactcagcagtgcgagcaactccctggcgatgagtggccagagtactacgagggtcaggactcggtccagattgctactcgcgcctgccgttatcagacttggacgtttacgggattgctgctgaatcacgcactgctctcgcagccccagggcattcaactgctgagtctgcggggcttaccctaa

SEQ ID NO: 73 - protein, 463 aa, Synechococcus PCC7942
MPDSVVLPATLQTALQTAEQLLWDRALVRYHDQWAGAIAALPEDQELAAANYREIFIRDNVPVMLYLLLQGKTDVVRDFLQLSLSLQSQALQTYGILPTSFVCEETHCVADYGQRAIGRVVSADPSLWWPVLLQAYRRASHDDAFVHSPTVQQGLQRLLAFLLRPVFNQNPLLEVPDGAFMVDRPLDVAGAPLEIQVLLYGALRACGQLLQYTEAANAAHVQARRLRQYLCWHYWVTPDRLRRWQQWPTEEFGDRSHNPYNIQPIAIPDWVEPWLGESGGYFLGNIRAGRPDFRFFSLGNLLAIVFDVLPLNQQGAILRLILQNEAQILGQVPLRLCYPALTGSAWKILTGCDPKNQPWSYHNGGSWPSLLWYLSAAVLHYQQRGGDRNLCQVWLNKLQHYHTQQCEQLPGDEWPEYYEGQDSVQIATRACRYQTWTFTGLLLNHALLSQPQGIQLLSLRGLP

SEQ ID NO: 74 - DNA, 966 bp, Synechocystis PCC6803
atgattaattgtcaattttgttccgttatttccaaatctaacggggaagatcctatcggcacagcaaattcaagtgatcgttggttaattatggaattaccccaaccttggacagaggaacgctttcatcatgaccccattcttaaaccaattcatgatctttttcatcaactttctgatcaaggagttaaagtatctccaatggcgatcgcctcagatcacgagtattctcaatcaggatttagtcgtattattcactaccaaaagtttaatttgctcttttccagttttataaaagaagaatatttagttcctgatgatcaaaggtgggatcttatcaaaaatttatgttatcaatctccagagttagaaaattttcgtaactataaactgtcagatgttgttgatcgagatatgatggtatgtactcatggaaacattgatgtggcttgttcgagatttggttatcctatttataaacaattacgacaaaaatatgcatcaaaaaatttaagaatatggcgctgctctcattttgggggacatcagtttgctccgactttaattgattttccaaatgggcaagtttggggacatcttgagtctgaagttttagataatctggtaaggcaagaaggtcaagttaaacaactttataaattttatcgaggttgggtaggcgtaacaaaatttgcccagattgttgagcgtgaaatttggactcaacgaggttggcaatggttaaattatcaaaaatcagctcaaatattgaacatggatgataatcagcatgatcccaattgggtagaggttcaatttgattttatttctcccgataaagttaaaggagcttattttgcaagagttgaagtcaatgggtcagtgatgactgctagaaattcaggagatgaacttatttctgtcaagcagtatagtgtcagctacttaaaagaaattgataaataa

SEQ ID NO: 75 - protein, 321 aa, Synechocystis PCC6803
MINCQFCSVISKSNGEDPIGTANSSDRWLIMELPQPWTEERFHHDPILKPIHDLFHQLSDQGVKVSPMAIASDHEYSQSGFSRIIHYQKFNLLFSSFIKEEYLVPDDQRWDLIKNLCYQSPELENFRNYKLSDVVDRDMMVCTHGNIDVACSRFGYPIYKQLRQKYASKNLRIWRCSHFGGHQFAPTLIDFPNGQVWGHLESEVLDNLVRQEGQVKQLYKFYRGWVGVTKFAQIVEREIWTQRGWQWLNYQKSAQILNMDDNQHDPNWVEVQFDFISPDKVKGAYFARVEVNGSVMTARNSGDELISVKQYSVSYLKEIDK

SEQ ID NO: 76 - DNA, 1425 bp, Escherichia coli
atgagtcgtttagtcgtagtatctaaccggattgcaccaccagacgagcacgccgccagtgccggtggccttgccgttggcatactgggggcactgaaagccgcaggcggactgtggtttggctggagtggtgaaacagggaatgaggatcagccgctaaaaaaggtgaaaaaaggtaacattacgtgggcctcttttaacctcagcgaacaggaccttgacgaatactacaaccaattctccaatgccgttctctggcccgcttttcattatcggctcgatctggtgcaatttcagcgtcctgcctgggacggctatctacgcgtaaatgcgttgctggcagataaattactgccgctgttgcaagacgatgacattatctggatccacgattatcacctgttgccatttgcgcatgaattacgcaaacggggagtgaataatcgcattggtttctttctgcatattcctttcccgacaccggaaatcttcaacgcgctgccgacatatgacaccttgcttgaacagctttgtgattatgatttgctgggtttccagacagaaaacgatcgtctggcgttcctggattgtctttctaacctgacccgcgtcacgacacgtagcgcaaaaagccatacagcctggggcaaagcatttcgaacagaagtctacccgatcggcattgaaccgaaagaaatagccaaacaggctgccgggccactgccgccaaaactggcgcaacttaaagcggaactgaaaaacgtacaaaatatcttttctgtcgaacggctggattattccaaaggtttgccagagcgttttctcgcctatgaagcgttgctggaaaaatatccgcagcatcatggtaaaattcgttatacccagattgcaccaacgtcgcgtggtgatgtgcaagcctatcaggatattcgtcatcagctcgaaaatgaagctggacgaattaatggtaaatacgggcaattaggctggacgccgctttattatttgaatcagcattttgaccgtaaattactgatgaaaatattccgctactctgacgtgggcttagtgacgccactgcgtgacgggatgaacctggtagcaaaagagtatgttgctgctcaggacccagccaatccgggcgttcttgttctttcgcaatttgcgggagcggcaaacgagttaacgtcggcgttaattgttaacccctacgatcgtgacgaagttgcagctgcgctggatcgtgcattgactatgtcgctggcggaacgtatttcccgtcatgcagaaatgctggacgttatcgtgaaaaacgatattaaccactggcaggagtgcttcattagcgacctaaagcagatagttccgcgaagcgcggaaagccagcagcgcgataaagttgctacctttccaaagcttgcgtag

SEQ ID NO: 77 - protein, 474 aa, Escherichia coli
MSRLVVVSNRIAPPDEHAASAGGLAVGILGALKAAGGLWFGWSGETGNEDQPLKKVKKGNITWASFNLSEQDLDEYYNQFSNAVLWPAFHYRLDLVQFQRPAWDGYLRVNALLADKLLPLLQDDDIIWIHDYHLLPFAHELRKRGVNNRIGFFLHIPFPTPEIFNALPTYDTLLEQLCDYDLLGFQTENDRLAFLDCLSNLTRVTTRSAKSHTAWGKAFRTEVYPIGIEPKEIAKQAAGPLPPKLAQLKAELKNVQNIFSVERLDYSKGLPERFLAYEALLEKYPQHHGKIRYTQIAPTSRGDVQAYQDIRHQLENEAGRINGKYGQLGWTPLYYLNQHFDRKLLMKIFRYSDVGLVTPLRDGMNLVAKEYVAAQDPANPGVLVLSQFAGAANELTSALIVNPYDRDEVAAALDRALTMSLAERISRHAEMLDVIVKNDINHWQECFISDLKQIVPRSAESQQRDKVATFPKLA

SEQ ID NO: 78 - DNA, 746 bp, Escherichia coli
atgatcttgatggaacgctggcggaaatcaaaccgcatcccgatcaggtcgtcgtgcctgacaatattctgcaaggactacagctactggcaaccgcaagtgatggtgcattggcattgatatcagggcgctcaatggtggagcttgacgcactggcaaaaccttatcgcttcccgttagcgggcgtgcatggggcggagcgccgtgacatcaatggtaaaacacatatcgttcatctgccggatgcgattgcgcgtgatattagcgtgcaactgcatacagtcatcgctcagtatcccggcgcggagctggaggcgaaagggatggcttttgcgctgcattatcgtcaggctccgcagcatgaagacgcattaatgacattagcgcaacgtattactcagatctggccacaaatggcgttacagcagggaaagtgtgttgtcgagatcaaaccgagaggtaccagtaaaggtgaggcaattgcagcttttatgcaggaagctccctttatcgggcgaacgcccgtatttctgggcgatgatttaaccgatgaatctggcttcgcagtcgttaaccgactgggcggaatgtcagtaaaaattggcacaggtgcaactcaggcatcatggcgactggcgggtgtgccggatgtctggagctggcttgaaatgataaccaccgcattacaacaaaaaagagaaaataacaggagtgatgactatgagtcgtttagtcgtagtatctaa

SEQ ID NO: 79 - protein, 266 aa, Escherichia coli
MTEPLTETPELSAKYAWFFDLDGTLAEIKPHPDQVVVPDNILQGLQLLATASDGALALISGRSMVELDALAKPYRFPLAGVHGAERRDINGKTHIVHLPDAIARDISVQLHTVIAQYPGAELEAKGMAFALHYRQAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 80 - DNA, 1500 bp, Synechocystis PCC6803
atgaattcatcccttgtgatcctttaccaccgtgagccctacgacgaagttagggaaaatggcaaaacggtgtatcgagagaaaaagagtcccaacgggattttgcccaccctcaaaagtttttttgccgatgcggaacagagcacctgggtcgcatggaaacaggtttcgccgaagcaaaaggatgattttcaggcggatatgtccattgaaggccttggcgatcgttgtacggtgcgccgggtgcccctgacggcggagcaggtaaaaaacttctatcacatcacttccaaggaagccttttggcccattctccactctttcccctggcagttcacctacgattcttctgattgggataattttcagcacattaaccgcttatttgccgaggcggcctgtgccgatgccgatgacaatgcattgttttgggtccacgactataacctctggttagcgcccctttacattcgtcagctcaagcccaacgccaagattgcctttttccaccacacccccttccccagcgttgatattttcaatattttgccctggcgggaggcgatcgtagaaagcttgctggcctgtgatctctgtggttttcatattccccgctacgtagaaaattttgtcgccgtggcccgtagtctcaagccggtggaaatcaccagacgggttgtggtagaccaagcctttaccccctacggtacggccctggcggaaccggaactcaccacccagttgcgttatggcgatcgcctcattaacctcgatgcgtttcccgtgggcaccaatccggcaaatatccgggcgatcgtggccaaagaaagtgtgcaacaaaaagttgctgaaattaaacaagatttaggcggtaagaggctaattgtttccgctgggcgggtggattacgtgaagggcaccaaggaaatgttgatgtgctatgaacgtctactggagcgtcgccccgaattgcagggggaaattagcctggtagtccccgtagccaaggccgctgagggaatgcgtatttatcgcaacgcccaaaacgaaattgaacgactggcagggaaaattaacggtcgctttgccaaactgtcctggacaccagtgatgctgttcacctctcctttagcctatgaggagctcattgccctgttctgtgccgccgacattgcctggatcactcccctgcgggatgggctaaacctggtggctaaggagtatgtggtggctaaaaatggcgaagaaggagttctgatcctctcggaatttgccggttgtgcggtggaactacccgatgcggtgttgactaacccctacgcttccagccgtatggacgaatccattgaccaggccctggccatggacaaagacgaacagaaaaaacgcatggggagaatgtacgccgccattaagcgttacgacgttcaacaatgggccaatcacctactgcgggaagcctacgccgatgtggtactgggagagcccccccaaatgtag

SEQ ID NO: 81 - protein, 499 aa, Synechocystis PCC6803
MNSSLVILYHREPYDEVRENGKTVYREKKSPNGILPTLKSFFADAEQSTWVAWKQVSPKQKDDFQADMSIEGLGDRCTVRRVPLTAEQVKNFYHITSKEAFWPILHSFPWQFTYDSSDWDNFQHINRLFAEAACADADDNALFWVHDYNLWLAPLYIRQLKPNAKIAFFHHTPFPSVDIFNILPWREAIVESLLACDLCGFHIPRYVENFVAVARSLKPVEITRRVVVDQAFTPYGTALAEPELTTQLRYGDRLINLDAFPVGTNPANIRAIVAKESVQQKVAEIKQDLGGKRLIVSAGRVDYVKGTKEMLMCYERLLERRPELQGEISLVVPVAKAAEGMRIYRNAQNEIERLAGKINGRFAKLSWTPVMLFTSPLAYEELIALFCAADIAWITPLRDGLNLVAKEYVVAKNGEEGVLILSEFAGCAVELPDAVLTNPYASSRMDESIDQALAMDKDEQKKRMGRMYAAIKRYDVQQWANHLLREAYADVVLGEPPQM

SEQ ID NO: 82 - DNA, 1269 bp, Synechocystis PCC6803
atggtattacaccaacaacgtttctccctcgaccatggagctttttgtcaaaccttagcccaaactgaaaatttactcattgtccaagacttggatggggtctgcatggaattagtgcaagatcccctcagtcgccgcctggatgccgattatgtccgggccaccaccctgtttgctgaacatttttacgtgttgaccaatggggagcacgtgggaaaaagaggagtacagggcattgtggaacaatcctttggggatgcttcctttgtgcaacaggaaggcctatatttgcccggtttggcggccgggggagtgcagtggcaggatcgccatggcaaagtaagtcatcctggagtggggcaaacggagctggagtttttagcggcggtgcccgaaaaaatcactaattgtttaaaaaccttttttggcgatcgcccccattccctatccccagagcaattacaaacgggcattgaagcttcggttttagataatgtggcttcccccaccgccaatttaaataccttggccaatctgttacaagactttccgcaaatttaccgagatttgcaggaaaccatggctcaattattggatcagttgatggcggaagccgttgcccagggtttggggaatagtttttttgtccactatgctcccaatttaggtagggatgaacgaggtaaggaaattattcgttgggccaaagctggggattccggcaccaccgattttcaatttatgttgcggggtggggtcaaagaagccggggttttggctttgctaaatcgttactatcacaatcggacagggcaatatcctctgggagaaagttttagtgctcgccaagcgcccccatcccaccaggacttgttgcatttggtgaaagcgcaatttgatccggccttgatgccgctgatcattggagttggggatacggtcaccagtcaggtggatgaagctaccggggaaattcgacgtggcgggagcgatcgccaatttttgcaattaatccaagatttgggggattggggaaatcacggtaacttagtggtgtatgtggacagttcccagggggaggtgaaaaatcgccaacctctacaactagaaaccgtggcggggcaaacccaagtggtggctggccctggggatatgcgggacagggaagagccattgaagatcaatgtggcttttcctggtggccatgaccaatatgtagcggcgtttaagcaggcggcccagcgccgaagagtccatttttcccagtag

SEQ ID NO: 83 - protein, 422 aa, Synechocystis PCC6803
MVLHQQRFSLDHGAFCQTLAQTENLLIVQDLDGVCMELVQDPLSRRLDADYVRATTLFAEHFYVLTNGEHVGKRGVQGIVEQSFGDASFVQQEGLYLPGLAAGGVQWQDRHGKVSHPGVGQTELEFLAAVPEKITNCLKTFFGDRPHSLSPEQLQTGIEASVLDNVASPTANLNTLANLLQDFPQIYRDLQETMAQLLDQLMAEAVAQGLGNSFFVHYAPNLGRDERGKEIIRWAKAGDSGTTDFQFMLRGGVKEAGVLALLNRYYHNRTGQYPLGESFSARQAPPSHQDLLHLVKAQFDPALMPLIIGVGDTVTSQVDEATGEIRRGGSDRQFLQLIQDLGDWGNHGNLVVYVDSSQGEVKNRQPLQLETVAGQTQVVAGPGDMRDREEPLKINVAFPGGHDQYVAAFKQAAQRRRVHFSQ

SEQ ID NO: 84 - DNA, 1365 bp, Agrobacterium tumefaciens
ttggaaaaatttaccaagatgggacccatgacaaccacgagcgaaactgaacgctatccgcggatagctctcatatcgacgcatggctatgtcgccgcacacccgcccctgggcgctgccgataccggggggcaggtggtttatgtgcttgagcttgcacgaaaactcggccaactcggttataccgtcgatctttacacccgacgcttcgaagaccagccggaattcgacgaggtcgatgagcgcgtccgtgtggtgcgcattccctgcggcgggcgcgatttcattcccaaggaatatctgcaccggcacctgatggaatggtgcgagaacgcgctacgcttcatcaaaaaaaacgacctcaattactccttcatcaacagccactactgggatgccggcgtggccgggcagcggctctccgaagcactgaaaatcccccatctgcacacgccgcactcgctcggcatctggaagaagcgccagatggagaccgattatccggaaaaggccgatacgttcgagcttgagttcaacttcaaggagcgcatccagcacgagctgatcatctatcgcagctgcgacatggtgatcgccaccacgccggtgcagctggacgtgctgatcgaagattatggcctgaagcgcaaacatatccacatgatcccgccgggttatgacgacaaccgcttcttccccgtctcggatgcgacgcgtcagatgatccggcagcgtttcggttttgaaggcaaagtggtgctggcactcggtcggctcgccaccaacaagggctacgacctgctgatcgacggcttttccgtgcttgccgagcgcgagccggaagcccgcctgcatctggccgtcggcggcgagaatatggacgagcaggaaaccaccattctcaaccagctgaaggagcgggtgaaatcgctcgggctggaagacaaggtggctttctctggttatgtcgcggacgaggatttgccggatatctatcgggctgccgatctcttcgtgctttccagccgctacgagcccttcggcatgaccgccatcgaggccatggcgagcggcacgccgaccgtcgtcaccatccatggcgggctgttccgcgccatcagctatgggcgacatgcgctgtttgccgatcctttcgacaaggaagatctcggcattaccatgatgaagccgttcaagcatgaacggctctacgggcggctttcgcgcatgggagcccacaaggcacgcagcctgttcacatggaccggaattgcccagcaacttctcgcgctcgtggaaggcaggaccatgatgccggttctggaagaagccgactgggccgaaccatggaatgacggcgattga

SEQ ID NO: 85 - protein, 454 aa, Agrobacterium tumefaciens
MEKFTKMGPMTTTSETERYPRIALISTHGYVAAHPPLGAADTGGQVVYVLELARKLGQLGYTVDLYTRRFEDQPEFDEVDERVRVVRIPCGGRDFIPKEYLHRHLMEWCENALRFIKKNDLNYSFINSHYWDAGVAGQRLSEALKIPHLHTPHSLGIWKKRQMETDYPEKADTFELEFNFKERIQHELIIYRSCDMVIATTPVQLDVLIEDYGLKRKHIHMIPPGYDDNRFFPVSDATRQMIRQRFGFEGKVVLALGRLATNKGYDLLIDGFSVLAEREPEARLHLAVGGENMDEQETTILNQLKERVKSLGLEDKVAFSGYVADEDLPDIYRAADLFVLSSRYEPFGMTAIEAMASGTPTVVTIHGGLFRAISYGRHALFADPFDKEDLGITMMKPFKHERLYGRLSRMGAHKARSLFTWTGIAQQLLALVEGRTMMPVLEEADWAEPWNDGD

SEQ ID NO: 86 - DNA, 747 bp, Agrobacterium tumefaciens
ttgaaaccgcttcgtcttctttccaccgatcttgacggaaccgtcgtcggcgataatgacgccacgcggcggttccgcgatttctggcacgcactgccggatgatcttcgcccggttctggtcttcaacagcggccggttgatcgacgatcagcttgcccttttggaagaggtgccgctgccgcagccggactacatcatcggcggtgtcggcaccatgctgcatgcaaaaaaacgcagcgaactggaaaccgcctatacacagtcgctcggcaccggttttgacccgcggaagattgccgatgtcatgaaccgcattgcgggcgtgacgatgcaggaggagcgttatcagcacggcctgaaatcgagctggttcctgcatgacgccgatgccgccgcgctcggcgagatcgaggccgcgcttctggccgccgatattgacgctcgtatcgtttattccagcgatcgcgacctcgacatattgccgaaggccgccgacaaaggcgcggcacttgcatggttgtgtggacaattgcgcatcggcctcgacgaatcagtggtctcgggtgatactggcaatgaccgtgcgatgtttgagttgaagactatccgcggcgtgatcgtgggcaatgccctgcctgagcttgtctcgctggcgcatcaggacaatcgcttttttcactcgaccgcgaaagaagcggatggcgtgatcgaaggcctgcggcactggggactgaacccccgctaa

SEQ ID NO: 87 - protein, 248 aa, Agrobacterium tumefaciens
MKPLRLLSTDLDGTVVGDNDATRRFRDFWHALPDDLRPVLVFNSGRLIDDQLALLEEVPLPQPDYIIGGVGTMLHAKKRSELETAYTQSLGTGFDPRKIADVMNRIAGVTMQEERYQHGLKSSWFLHDADAAALGEIEAALLAADIDARIVYSSDRDLDILPKAADKGAALAWLCGQLRIGLDESVVSGDTGNDRAMFELKTIRGVIVGNALPELVSLAHQDNRFFHSTAKEADGVIEGLRHWGLNPR

SEQ ID NO: 88 - DNA, 35 bp, Artificial Sequence
  PCR primer
  misc_feature (7)..(12): BamHI restriction site
tctcagggatcccataccatgattaaaaaaagtac

SEQ ID NO: 89 - DNA, 26 bp, Artificial Sequence
  PCR primer
  misc_feature (7)..(12): SacI restriction site
ggccgtgagctcagaaccaggtttcc

SEQ ID NO: 90 - DNA, 1546 bp, Artificial Sequence
  PCR product
  misc_feature (7)..(12): BamHI restriction site
  misc_feature (1535)..(1540): SacI restriction site
tctcagggatcccataccatgattaaaaaaagtacgcttgcccttacccttggcttaatggccggtactcccgccgcctttgccgacagcaatatgtccagcattgaggcgcgtctcgccgcgctggaacaacgtcttcaggcggctgaacagcgcgccagcgcggcggaaacccgcgctgaagccgcagagcgtcaggcacaggcgcttgccgcgcaacaaaaagcgcagccgccggttcagcctgtcgccgcgcaacctgcgccgcagcccgccacgcaaacggcggataacagcgggtttgaattccacggctacgcccgctcgggcctgctgatgaacgattccgccgcgaaaacgcagggcggcccgtccttcacgccagcgggtgaaaccggcggtcacgtcgggcgtctcggcaatgagccggacacttaccttgaaatgaacctagagcacaaacagacgctcgcgaacggcgccaccacgcgctttaaagtgatggtcgctgacggtcagcgcagctataacgactggacggcctccaccagcgatctcaacgtgcgccaggcgtttaccgaactcggccacctgccgaccttcatcggcgcgtttaaagatgccaccgtctgggccggtaaacgcttcgatcgtgataacttcgatatccactggattgactccgacgtggtgttcctcgccggtacgggtgcgggtatctacgacatgcgctggagcgataacgcccgcagtaacttctcgctgtatggccgcaccttcggcgatatcgaaaacagcgaaaacaccgcccagaactatatccttacgcttaataactacgtcgggccggtacagctgatggtgagcgggatgcgcgccaaagataacgaagaccgcgtggatatcgagggtaaccgcgtgaaaaaagacgcggcggaagatggcgtgcatgcgctgctcggcctgcataacgacagcttctacggtctgagcgacggctcctcgaaaaccgcactgctgtatggacatggcctgggcgcggaagtgaaatccatcggctccgatggcgcgctgctgccgcaggccgatacctggcgtctcgcgacctacggcatgacaccgctcggcggcggctggcatatcgcaccggcggtgctggcgcagagcagtaaagatcgctacgtcaaaggcgacagctaccagtgggcgaccgccaacctgcgcctcattcaggagattaaccagaactttgagctgcagtatgagggcagctatcagtacatggatctgcgcccgaaaggttacaacgaccgcaacgcggtcagcggcaacttctataagctgacctttgcgccgacgctgaaagcgggcgacgtgggcgaattcctcaagcgtcctgaactgcgcctgttcgccacctggatggactgggatcatcgcctggataactacgccagcaatgatgcctttggcagcaccggctttaccgccggcggtgaatggaacttcggcgtacagatggaaacctggttctgagctcacggcc

SEQ ID NO: 91 - DNA, 13332 bp, Artificial Sequence
  artifical plasmid pLybAL32 containing scrY
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggtcgactctagatggctacgagggcagacagtaagtggatttaccataatcccttaattgtacgcaccgctaaaacgcgttcagcgcgatcacggcagcagacaggtaaaaatggcaacaaaccaccctaaaaactgcgcgatcgcgcctgataaattttaaccgtatgaatacctatgcaaccagagggtacaggccacattacccccacttaatccactgaagctgccatttttcatggtttcaccatcccagcgaagggccatgcatgcatcgaaattaatacgacgaaattaatacgactcactatagggcaattgttatcagctatgcgccgaccagaacaccttgccgatcagccaaacgtctcttcaggccactgactagcgataactttccccacaacggaacaactctcactgcatgggatcattgggtactgtgggtttagtggttgtaaaaacacctgaccgctatccctgatcagtttcttgaaggtaaactcatcacccccaagtctggctatgcagaaatcacctggctcaacagcctgctcagggtcaacgagaattaacattccgtcaggaaagcttggcttggagcctgttggtgcggtcatggaattaccttcaacctcaagccagaatgcagaatcactggctttcttggttgtgcttacccatctctccgcatcacctttggtaaaggttctaagcttaggtgagaacatccctgcctgaacatgagaaaaaacagggtactcatactcacttctaagtgacggctgcatactaaccgcttcatacatctcgtagatttctctggcgattgaagggctaaattcttcaacgctaactttgagaatttttgtaagcaatgcggcgttataagcatttaatgcattgatgccattaaataaagcaccaacgcctgactgccccatccccatcttgtctgcgacagattcctgggataagccaagttcatttttctttttttcataaattgctttaaggcgacgtgcgtcctcaagctgctcttgtgttaatggtttcttttttgtgctcatacgttaaatctatcaccgcaagggataaatatctaacaccgtgcgtgttgactattttacctctggcggtgataatggttgcatcttaagaaggaggatcccataccatgattaaaaaaagtacgcttgcccttacccttggcttaatggccggtactcccgccgcctttgccgacagcaatatgtccagcattgaggcgcgtctcgccgcgctggaacaacgtcttcaggcggctgaacagcgcgccagcgcggcggaaacccgcgctgaagccgcagagcgtcaggcacaggcgcttgccgcgcaacaaaaagcgcagccgccggttcagcctgtcgccgcgcaacctgcgccgcagcccgccacgcaaacggcggataacagcgggtttgaattccacggctacgcccgctcgggcctgctgatgaacgattccgccgcgaaaacgcagggcggcccgtccttcacgccagcgggtgaaaccggcggtcacgtcgggcgtctcggcaatgagccggacacttaccttgaaatgaacctagagcacaaacagacgctcgcgaacggcgccaccacgcgctttaaagtgatggtcgctgacggtcagcgcagctataacgactggacggcctccaccagcgatctcaacgtgcgccaggcgtttaccgaactcggccacctgccgaccttcatcggcgcgtttaaagatgccaccgtctgggccggtaaacgcttcgatcgtgataacttcgatatccactggattgactccgacgtggtgttcctcgccggtacgggtgcgggtatctacgacatgcgctggagcgataacgcccgcagtaacttctcgctgtatggccgcaccttcggcgatatcgaaaacagcgaaaacaccgcccagaactatatccttacgcttaataactacgtcgggccggtacagctgatggtgagcgggatgcgcgccaaagataacgaagaccgcgtggatatcgagggtaaccgcgtgaaaaaagacgcggcggaagatggcgtgcatgcgctgctcggcctgcataacgacagcttctacggtctgagcgacggctcctcgaaaaccgcactgctgtatggacatggcctgggcgcggaagtgaaatccatcggctccgatggcgcgctgctgccgcaggccgatacctggcgtctcgcgacctacggcatgacaccgctcggcggcggctggcatatcgcaccggcggtgctggcgcagagcagtaaagatcgctacgtcaaaggcgacagctaccagtgggcgaccgccaacctgcgcctcattcaggagattaaccagaactttgagctgcagtatgagggcagctatcagtacatggatctgcgcccgaaaggttacaacgaccgcaacgcggtcagcggcaacttctataagctgacctttgcgccgacgctgaaagcgggcgacgtgggcgaattcctcaagcgtcctgaactgcgcctgttcgccacctggatggactgggatcatcgcctggataactacgccagcaatgatgcctttggcagcaccggctttaccgccggcggtgaatggaacttcggcgtacagatggaaacctggttctgagctcgaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 92 - DNA, 21 bp, Artificial Sequence
  PCR primer
gcagtaacttctcgctgtatg

SEQ ID NO: 93 - DNA, 23 bp, Artificial Sequence
  PCR primer
gtgttttcgctgttttcgatatc

SEQ ID NO: 94 - DNA, 1518 bp, Enterobacter sakazakii
atgattaaaaaaagtacgcttgcccttacccttggcttaatggccggtactcccgccgcctttgccgacagcaatatgtccagcattgaggcgcgtctcgccgcgctggaacaacgtcttcaggcggctgaacagcgcgccagcgcggcggaaacccgcgctgaagccgcagagcgtcaggcacaggcgcttgccgcgcaacaaaaagcgcagccgccggttcagcctgtcgccgcgcaacctgcgccgcagcccgccacgcaaacggcggataacagcgggtttgaattccacggctacgcccgctcgggcctgctgatgaacgattccgccgcgaaaacgcagggcggcccgtccttcacgccagcgggtgaaaccggcggtcacgtcgggcgtctcggcaatgagccggacacttaccttgaaatgaacctagagcacaaacagacgctcgcgaacggcgccaccacgcgctttaaagtgatggtcgctgacggtcagcgcagctataacgactggacggcctccaccagcgatctcaacgtgcgccaggcgtttaccgaactcggccacctgccgaccttcatcggcgcgtttaaagatgccaccgtctgggccggtaaacgcttcgatcgtgataacttcgatatccactggattgactccgacgtggtgttcctcgccggtacgggtgcgggtatctacgacatgcgctggagcgataacgcccgcagtaacttctcgctgtatggccgcaccttcggcgatatcgaaaacagcgaaaacaccgcccagaactatatccttacgcttaataactacgtcgggccggtacagctgatggtgagcgggatgcgcgccaaagataacgaagaccgcgtggatatcgagggtaaccgcgtgaaaaaagacgcggcggaagatggcgtgcatgcgctgctcggcctgcataacgacagcttctacggtctgagcgacggctcctcgaaaaccgcactgctgtatggacatggcctgggcgcggaagtgaaatccatcggctccgatggcgcgctgctgccgcaggccgatacctggcgtctcgcgacctacggcatgacaccgctcggcggcggctggcatatcgcaccggcggtgctggcgcagagcagtaaagatcgctacgtcaaaggcgacagctaccagtgggcgaccgccaacctgcgcctcattcaggagattaaccagaactttgagctgcagtatgagggcagctatcagtacatggatctgcgcccgaaaggttacaacgaccgcaacgcggtcagcggcaacttctataagctgacctttgcgccgacgctgaaagcgggcgacgtgggcgaattcctcaagcgtcctgaactgcgcctgttcgccacctggatggactgggatcatcgcctggataactacgccagcaatgatgcctttggcagcaccggctttaccgccggcggtgaatggaacttcggcgtacagatggaaacctggttctga

SEQ ID NO: 95 - protein, 505 aa, Enterobacter sakazakii
MIKKSTLALTLGLMAGTPAAFADSNMSSIEARLAALEQRLQAAEQRASAAETRAEAAERQAQALAAQQKAQPPVQPVAAQPAPQPATQTADNSGFEFHGYARSGLLMNDSAAKTQGGPSFTPAGETGGHVGRLGNEPDTYLEMNLEHKQTLANGATTRFKVMVADGQRSYNDWTASTSDLNVRQAFTELGHLPTFIGAFKDATVWAGKRFDRDNFDIHWIDSDVVFLAGTGAGIYDMRWSDNARSNFSLYGRTFGDIENSENTAQNYILTLNNYVGPVQLMVSGMRAKDNEDRVDIEGNRVKKDAAEDGVHALLGLHNDSFYGLSDGSSKTALLYGHGLGAEVKSIGSDGALLPQADTWRLATYGMTPLGGGWHIAPAVLAQSSKDRYVKGDSYQWATANLRLIQEINQNFELQYEGSYQYMDLRPKGYNDRNAVSGNFYKLTFAPTLKAGDVGEFLKRPELRLFATWMDWDHRLDNYASNDAFGSTGFTAGGEWNFGVQMETWF

SEQ ID NO: 96 - DNA, 30 bp, Artificial Sequence
  PCR primer
ccacaatggactgccagccgtcaaaggatg

SEQ ID NO: 97 - DNA, 30 bp, Artificial Sequence
  PCR primer
gcccaactggtcacggacatcgtcgataac

SEQ ID NO: 98 - DNA, 29 bp, Artificial Sequence
  PCR primer
tgcaatggctccaggaagcccgatcgatg

SEQ ID NO: 99 - DNA, 30 bp, Artificial Sequence
  PCR primer
ggcagcattacggctcagaccttggtcatg

SEQ ID NO: 100 - DNA, 1246 bp, Synechocystis PCC6803
ccacaatggactgccagccgtcaaaggatggttgtttgctcataatgcttgcctgtctgtcgttgaacttgggggaaatccctgcccaaagtatggcagaaaacctttcccttcccaatgccccaacttccggtaacccgatctgagctacagtggagttccgcggtgaattgttaccgacggtgagaccacgtcctaacttttagcccatttttcggttccccaacggccaagattaacaaaattaaattttagatattaacttttaagttttcccatggcttctcaattacgtgtttatgtgccggagcatcctctaattaagcattggttgggggtagctagggatgaaaacacgccgccggttttgtttaaaactgccatgggggaattgggacgttggttgacctatgaggccgctcgttattggttgccgacggtggatacggaagtgaaaactcccctggcgatcgccaaggccagtcttattgacccccaaacgccctttgtcattgtgcccattttgcgggcggggttggctctggtggaaggggcccaggggttgttgcccctggcaaaaatttaccatctgggtttagtgcgcaatgaaactaccctggaacctagtctgtatctgaacaagttgccggagcggtttgcccccggtacccatcttttgttgctagatcccatgttggctacgggtaataccatcatggctgctttggatttgctgatggcccgggacattgatgccaatttaatccgtttggtctccgtggtggccgcccccactgccctgcaaaaattaagtaatgcccatcccaatttgaccatctacaccgccatgattgacgaacaactcaatgaccggggttacattgtgcccggcctaggggatgcaggcgatcgttgctttggtacttgataacaccattaaactagtgatcaaataattacaaattcacccccaaacgttaacaacaggagtaaagtcatggctcaaaaagataacttcgccggaggatttttattaggtacggtcattggtggcgtagtggggggaattttgggttctgtcctggccaatcgagctgctacccaaagccccgaccgggaaaaattagacactgagggggtaggaaatctcgatagtgaggaaaatattgagttggctcgccgtcgcctggaagacaaaattgcccaacttaatttggttatcgacgatgtccgtgaccagttgggc

SEQ ID NO: 101 - DNA, 1281 bp, Synechococcus PCC7942
tgcaatggctccaggaagcccgatcgatgggatttcaagtcgctttagatgattttgggacgggttattccagccttggttacctcaagcgtttgcccatcaatgctctcaaaattgatcgcagctttattcgcgatctgccgcacgaccatgacgatcaagcgatcgtgcaggcgattgttgcaatggccaaggtcttgaaacttcgcacgatcgcagaaggcgtagaacgcctcgagcaagccgccttcttagaagcgattggttgtgatgctgtgcaagggttcttctatggcccaccactgcccgaagcagaagcgcttgccttcctgcaccgttccgcttcccctggggtctgaacgttaaaatcaggagctgtcttctgctgattggcatggctcctcaactgcgtatcttcgtgccgccccatcccttaattcggcactggctgggcattgcccgcgatcgccagacgccgacgcctctgtttcgcaccgcgatcgcagagctgggccgctggctcgcctatgaggctgtgcgggaatggctaccaacgattccagcggcggtgcaaactcctcttgcagaaaccccagcggagttcgtcgatttttcgcaacccttggcgatcgtgccgattctgcgcgcaggtctgggtttagtggagtctgtccaacaggttttgccgactgcccgcatttttcacgtgggtctcaagcgggatgaagtcagtcttgaaccgcgctgctacctcaatcacctgccagagcaacttgaagtgaacagtcgcgttctggttctcgacccgatgctggcgacaggtggctcgctgctctatacccttgatttgctgcgcgatcgcggtgtctctgctgagcaagtgcgggtgctttcaattgtggctgccccgccagcgctacaaaaactcagtcaagcctacccggcgttgacgatttacagcgccatcattgatgagcagctgaacgacaaaggctttatcgtgccggggctgggggatgctggcgatcgcctgtttggtactccttgatctgctgactgaattcgctaggcttcagcgttgagcaaagcctgaacggcctgccgaatgaagctttcatcctgcggattttggctggggttgcccgcgcggtgaccccagatcgagggaattgggcaatagtgcgccttaggaatcaactgcgcttcggcctcacaatcctctggggtgaagtagagatctgttgtcgagggcatgaccaaggtctgagccgtaatgctgcc

SEQ ID NO: 102 - DNA, 9385 bp, Artificial Sequence
  plasmid pLybAL3f containing Synechocystis upp gene
gcggccgcaaggggttcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcagctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcccacgcccaactggtcacggacatcgtcgataaccaaattaagttgggcaattttgtcttccaggcgacggcgagccaactcaatattttcctcactatcgagatttcctaccccctcagtgtctaatttttcccggtcggggctttgggtagcagctcgattggccaggacagaacccaaaattccccccactacgccaccaatgaccgtacctaataaaaatcctccggcgaagttatctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatgggtaccgggggcaaaccgctccggcaacttgttcagatacagactaggttccagggtagtttcattgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaaacttaaaagttaatatctaaaatttaattttgttaatcttggccgttggggaaccgaaaaatgggctaaaagttaggacgtggtctcaccgtcggtaacaattcaccgcggaactccactgtagctcagatcgggttaccggaagttggggcattgggaagggaaaggttttctgccatactttgggcagggatttcccccaagttcaacgacagacaggcaagcattatgagcaaacaaccatcctttgacggctggcagtccattgtgggtgggatcctctagagtcgacctgcaggcatgcaagcttgagtattctatagtctcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggtcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtccgagctcatcgctaataacttcgtatagcatacattatacgaagttatattcgat

SEQ ID NO: 103 - DNA, 9420 bp, Artificial Sequence
  plasmid pLybAL5f containing Synechococcus upp gene
gcggccgcaaggggttcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcagctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcccacggcagcattacggctcagaccttggtcatgccctcgacaacagatctctacttcaccccagaggattgtgaggccgaagcgcagttgattcctaaggcgcactattgcccaattccctcgatctggggtcaccgcgcgggcaaccccagccaaaatccgcaggatgaaagcttcattcggcaggccgttcaggctttgctcaacgctgaagcctagcgaattcagtcagcagatcaaggagtaccaaacaggcgatcgccagcatcccccagccccggcacgataaagcctttgtcgttcagctgctcatcaatgatggcgctgtaaatcgtcaacgccgggtaggcttgactgagtttttgtagcgctggcggggcagccacaattgaaagcacccgcacttgctcagcagagacaccgcgatcgcgcagcaaatcaagggtatagagcagcgagccacctgtcgccagcatcgggtcgagaaccagaacgcgactgttcacttcaagttgctctggcaggtgattgaggtagcagcgcggttcaagactgacttcatcccgcttgagacccacgtgaaaaatgcgggcagtcggcaaaacctgttggacagactccactaaacccagacctgcgcgcagaatcggcacgatcgccaagggttgcgaaaaatcgacgaactccgctggggtttctgcaagaggagtttgcaccgccgctggaatcgttggtagccattcccgcacagcctcataggcgagccagcggcccagctctgcgatcgcggtgcgaaacagaggcgtcggcgtctggcgatcgcgggcaatgcccagccagtgccgaattaagggatggggcggcacgaagatacgcagttgaggagccatgccaatcagcagaagacagctcctgattttaacgttcagaccccaggggaagcggaacggtgcaggaaggcaagcgcttctgcttcgggcagtggtgggccatagaagaacccttgcacagcatcacaaccaatcgcttctaagaaggcggcttgctcgaggcgttctacgccttctgcgatcgtgcgaagtttcaagaccttggccattgcaacaatcgcctgcacgatcgcttgatcgtcatggtcgtgcggcagatcgcgaataaagctgcgatcaattttgagagcattgatgggcaaacgcttgaggtaaccaaggctggaataacccgtcccaaaatcatctaaagcgacttgaaatcccatcgatcgggcttcctggagccattgcagtgggatcctctagagtcgacctgcaggcatgcaagcttgagtattctatagtctcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggtcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgttaaccgggctgcatccgatgcaagtgtgtcgctgtcgacgagctcgcgagctcggacatgaggttgccccgtattcagtgtcgctgatttgtattgtctgaagttgtttttacgttaagttgatgcagatcaattaatacgatacctgcgtcataattgattatttgacgtggtttgatggcctccacgcacgttgtgatatgtagatgataatcattatcactttacgggtcctttccggtgatccgacaggttacggggcggcgacctcgcgggttttcgctatttatgaaaattttccggtttaaggcgtttccgttcttcttcgtcataacttaatgtttttatttaaaataccctctgaaaagaaaggaaacgacaggtgctgaaagcgagctttttggcctctgtcgtttcctttctctgtttttgtccgtggaatgaacaatggaagtccgagctcatcgctaataacttcgtatagcatacattatacgaagttatattcgat

SEQ ID NO: 104 - DNA, 22 bp, Artificial Sequence
  PCR primer
gtaatacgactcactatagggc

SEQ ID NO: 105 - DNA, 24 bp, Artificial Sequence
  PCR primer
cacacaggaaacagctatgaccat

SEQ ID NO: 106 - DNA, 5641 bp, Artificial Sequence
  plasmid pLybAL4f containing Synechocystis upp gene
tgcaccatatgcggtgtgaaataccgcacagatgcgtaaggagaaaataccgcatcaggcgccattcgccattcagctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcccacgcccaactggtcacggacatcgtcgataaccaaattaagttgggcaattttgtcttccaggcgacggcgagccaactcaatattttcctcactatcgagatttcctaccccctcagtgtctaatttttcccggtcggggctttgggtagcagctcgattggccaggacagaacccaaaattccccccactacgccaccaatgaccgtacctaataaaaatcctccggcgaagttatctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatgggtaccgggggcaaaccgctccggcaacttgttcagatacagactaggttccagggtagtttcattgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaaacttaaaagttaatatctaaaatttaattttgttaatcttggccgttggggaaccgaaaaatgggctaaaagttaggacgtggtctcaccgtcggtaacaattcaccgcggaactccactgtagctcagatcgggttaccggaagttggggcattgggaagggaaaggttttctgccatactttgggcagggatttcccccaagttcaacgacagacaggcaagcattatgagcaaacaaccatcctttgacggctggcagtccattgtgggtgggatcctctagagtcgacctgcaggcatgcaagcttgagtattctatagtctcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggtcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctga

SEQ ID NO: 107 - DNA, 5218 bp, Artificial Sequence
  plasmid pLybAL9f containing partially deleted Synechocystis upp gene
tgcaccatatgcggtgtgaaataccgcacagatgcgtaaggagaaaataccgcatcaggcgccattcgccattcagctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcccacgcccaactggtcacggacatcgtcgataaccaaattaagttgggcaattttgtcttccaggcgacggcgagccaactcaatattttcctcactatcgagatttcctaccccctcagtgtctaatttttcccggtcggggctttgggtagcagctcgattggccaggacagaacccaaaattccccccactacgccaccaatgaccgtacctaataaaaatcctccggcgaagttatctttttgagccatgactttactcctgttgttaacgtttgggggtgaatttgtaattatttgatcactagtttaatggtgttatcaagtaccaaagcaacgatcgcctgcatcccctagcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaaacttaaaagttaatatctaaaatttaattttgttaatcttggccgttggggaaccgaaaaatgggctaaaagttaggacgtggtctcaccgtcggtaacaattcaccgcggaactccactgtagctcagatcgggttaccggaagttggggcattgggaagggaaaggttttctgccatactttgggcagggatttcccccaagttcaacgacagacaggcaagcattatgagcaaacaaccatcctttgacggctggcagtccattgtgggtgggatcctctagagtcgacctgcaggcatgcaagcttgagtattctatagtctcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggtcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctga

SEQ ID NO: 108 - DNA, 880 bp, Artificial Sequence
  sequence of partially deleted Synechocystis upp
gagctcggtacccggggatcccacgcccaactggtcacggacatcgtcgataaccaaattaagttgggcaattttgtcttccaggcgacggcgagccaactcaatattttcctcactatcgagatttcctaccccctcagtgtctaatttttcccggtcggggctttgggtagcagctcgattggccaggacagaacccaaaattccccccactacgccaccaatgaccgtacctaataaaaatcctccggcgaagttatctttttgagccatgactttactcctgttgttaacgtttgggggtgaatttgtaattatttgatcactagtttaatggtgttatcaagtaccaaagcaacgatcgcctgcatcccctagcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaaacttaaaagttaatatctaaaatttaattttgttaatcttggccgttggggaaccgaaaaatgggctaaaagttaggacgtggtctcaccgtcggtaacaattcaccgcggaactccactgtagctcagatcgggttaccggaagttggggcattgggaagggaaaggttttctgccatactttgggcagggatttcccccaagttcaacgacagacaggcaagcattatgagcaaacaaccatcctttgacggctggcagtccattgtgggtgggatcctctagagtcgacctgcaggcatgc

SEQ ID NO: 109 - DNA, 5800 bp, Artificial Sequence
  plasmid pLybAL6fb containing Synechococcus upp gene
tgcaccatatgcggtgtgaaataccgcacagatgcgtaaggagaaaataccgcatcaggcgccattcgccattcagctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcccacggcagcattacggctcagaccttggtcatgccctcgacaacagatctctacttcaccccagaggattgtgaggccgaagcgcagttgattcctaaggcgcactattgcccaattccctcgatctggggtcaccgcgcgggcaaccccagccaaaatccgcaggatgaaagcttcattcggcaggccgttcaggctttgctcaacgctgaagcctagcgaattcagtcagcagatcaaggagtaccaaacaggcgatcgccagcatcccccagccccggcacgataaagcctttgtcgttcagctgctcatcaatgatggcgctgtaaatcgtcaacgccgggtaggcttgactgagtttttgtagcgctggcggggcagccacaattgaaagcacccgcacttgctcagcagagacaccgcgatcgcgcagcaaatcaagggtatagagcagcgagccacctgtcgccagcatcgggtcgagaaccagaacgcgactgttcacttcaagttgctctggcaggtgattgaggtagcagcgcggttcaagactgacttcatcccgcttgagacccacgtgaaaaatgcgggcagtcggcaaaacctgttggacagactccactaaacccagacctgcgcgcagaatcggcacgatcgccaagggttgcgaaaaatcgacgaactccgctggggtttctgcaagaggagtttgcaccgccgctggaatcgttggtagccattcccgcacagcctcataggcgagccagcggcccagctctgcgatcgcggtgcgaaacagaggcgtcggcgtctggcgatcgcgggcaatgcccagccagtgccgaattaagggatggggcggcacgaagatacgcagttgaggagccatgccaatcagcagaagacagctcctgattttaacgttcagaccccaggggaagcggaacggtgcaggaaggcaagcgcttctgcttcgggcagtggtgggccatagaagaacccttgcacagcatcacaaccaatcgcttctaagaaggcggcttgctcgaggcgttctacgccttctgcgatcgtgcgaagtttcaagaccttggccattgcaacaatcgcctgcacgatcgcttgatcgtcatggtcgtgcggcagatcgcgaataaagctgcgatcaattttgagagcattgatgggcaaacgcttgaggtaaccaaggctggaataacccgtcccaaaatcatctaaagcgacttgaaatcccatcgatcgggcttcctggagccattgcagtgggatcctctagagtcgacctgcaggcatgcaagcttgagtattctatagtctcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggtcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttat

SEQ ID NO: 110 - DNA, 5731 bp, Artificial Sequence
  plasmid pLybAL10fb containing partially deleted Synechococcus upp gene
tgcaccatatgcggtgtgaaataccgcacagatgcgtaaggagaaaataccgcatcaggcgccattcgccattcagctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcccacggcagcattacggctcagaccttggtcatgccctcgacaacagatctctacttcaccccagaggattgtgaggccgaagcgcagttgattcctaaggcgcactattgcccaattccctcgatctggggtcaccgcgcgggcaaccccagccaaaatccgcaggatgaaagcttcattcggcaggccgttcaggctttgctcaacgctgaagcctagcgaattcagtcagcagatcaaggagtaccaaacaggcgatcgccagcatcccccagccccggcacgataaagcctttgtcgttcagctgctcatcaatgatggcgctgtaaatcgtcaacgccgggtaggcttgactgagtttttgtagcgctggcggggcagccacaattgaaagcacccgcacttgctcagcagagacaccgcgatcgcgcagcaaatcaagggtatagagcagcgagccacctgtcgccagcatcgggtcgagaaccagaacgcgactgttcacttcaagttgctctggcaggtgattgaggtagcagcgcggttcaagactgacttcatcccgctcgcgcagaatcggcacgatcgccaagggttgcgaaaaatcgacgaactccgctggggtttctgcaagaggagtttgcaccgccgctggaatcgttggtagccattcccgcacagcctcataggcgagccagcggcccagctctgcgatcgcggtgcgaaacagaggcgtcggcgtctggcgatcgcgggcaatgcccagccagtgccgaattaagggatggggcggcacgaagatacgcagttgaggagccatgccaatcagcagaagacagctcctgattttaacgttcagaccccaggggaagcggaacggtgcaggaaggcaagcgcttctgcttcgggcagtggtgggccatagaagaacccttgcacagcatcacaaccaatcgcttctaagaaggcggcttgctcgaggcgttctacgccttctgcgatcgtgcgaagtttcaagaccttggccattgcaacaatcgcctgcacgatcgcttgatcgtcatggtcgtgcggcagatcgcgaataaagctgcgatcaattttgagagcattgatgggcaaacgcttgaggtaaccaaggctggaataacccgtcccaaaatcatctaaagcgacttgaaatcccatcgatcgggcttcctggagccattgcagtgggatcctctagagtcgacctgcaggcatgcaagcttgagtattctatagtctcacctaaatagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgaaccccttgcggccgcccgggccgtcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgaaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggtcgagtgagcgaggaagcaccagggaacagcacttatatattctgcttacacacgatgcctgaaaaaacttcccttggggttatccacttatccacggggatatttttataattattttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttat

SEQ ID NO: 111 - DNA, 651 bp, Synechocystis PCC6803; identical to SEQ ID NO: 56

SEQ ID NO: 112 - protein, 216 aa, Synechocystis PCC6803; identical to SEQ ID NO: 57

SEQ ID NO: 113 - DNA, 654 bp, Synechococcus PCC7942; identical to SEQ ID NO: 58

SEQ ID NO: 114 - protein, 217 aa, Synechococcus PCC7942; identical to SEQ ID NO: 59

SEQ ID NO: 115 - DNA, 2184 bp, Artificial Sequence
  PCR product
  misc_feature (7)..(12): AflI restriction site
  misc_feature (2173)..(2178): NheI restriction site
ttgcatcttaagaaggaggatccatatgatcttgatggaacgctggcggaaatcaaaccgcatcccgatcaggtcgtcgtgcctgacaatattctgcaaggactacagctactggcaaccgcaagtgatggtgcattggcattgatatcagggcgctcaatggtggagcttgacgcactggcaaaaccttatcgcttcccgttagcgggcgtgcatggggcggagcgccgtgacatcaatggtaaaacacatatcgttcatctgccggatgcgattgcgcgtgatattagcgtgcaactgcatacagtcatcgctcagtatcccggcgcggagctggaggcgaaagggatggcttttgcgctgcattatcgtcaggctccgcagcatgaagacgcattaatgacattagcgcaacgtattactcagatctggccacaaatggcgttacagcagggaaagtgtgttgtcgagatcaaaccgagaggtaccagtaaaggtgaggcaattgcagcttttatgcaggaagctccctttatcgggcgaacgcccgtatttctgggcgatgatttaaccgatgaatctggcttcgcagtcgttaaccgactgggcggaatgtcagtaaaaattggcacaggtgcaactcaggcatcatggcgactggcgggtgtgccggatgtctggagctggcttgaaatgataaccaccgcattacaacaaaaaagagaaaataacaggagtgatgactatgagtcgtttagtcgtagtatctaaccggattgcaccaccagacgagcacgccgccagtgccggtggccttgccgttggcatactgggggcactgaaagccgcaggcggactgtggtttggctggagtggtgaaacagggaatgaggatcagccgctaaaaaaggtgaaaaaaggtaacattacgtgggcctcttttaacctcagcgaacaggaccttgacgaatactacaaccaattctccaatgccgttctctggcccgcttttcattatcggctcgatctggtgcaatttcagcgtcctgcctgggacggctatctacgcgtaaatgcgttgctggcagataaattactgccgctgttgcaagacgatgacattatctggatccacgattatcacctgttgccatttgcgcatgaattacgcaaacggggagtgaataatcgcattggtttctttctgcatattcctttcccgacaccggaaatcttcaacgcgctgccgacatatgacaccttgcttgaacagctttgtgattatgatttgctgggtttccagacagaaaacgatcgtctggcgttcctggattgtctttctaacctgacccgcgtcacgacacgtagcgcaaaaagccatacagcctggggcaaagcatttcgaacagaagtctacccgatcggcattgaaccgaaagaaatagccaaacaggctgccgggccactgccgccaaaactggcgcaacttaaagcggaactgaaaaacgtacaaaatatcttttctgtcgaacggctggattattccaaaggtttgccagagcgttttctcgcctatgaagcgttgctggaaaaatatccgcagcatcatggtaaaattcgttatacccagattgcaccaacgtcgcgtggtgatgtgcaagcctatcaggatattcgtcatcagctcgaaaatgaagctggacgaattaatggtaaatacgggcaattaggctggacgccgctttattatttgaatcagcattttgaccgtaaattactgatgaaaatattccgctactctgacgtgggcttagtgacgccactgcgtgacgggatgaacctggtagcaaaagagtatgttgctgctcaggacccagccaatccgggcgttcttgttctttcgcaatttgcgggagcggcaaacgagttaacgtcggcgttaattgttaacccctacgatcgtgacgaagttgcagctgcgctggatcgtgcattgactatgtcgctggcggaacgtatttcccgtcatgcagaaatgctggacgttatcgtgaaaaacgatattaaccactggcaggagtgcttcattagcgacctaaagcagatagttccgcgaagcgcggaaagccagcagcgcgataaagttgctacctttccaaagcttgcgtaggagctagcaatctc

SEQ ID NO: 116 - DNA, 46 bp, Artificial Sequence
  PCR primer
  misc_feature (7)..(12): AflI restriction site
ttgcatcttaagaaggaggatccatatgatcttgatggaacgctgg

SEQ ID NO: 117 - DNA, 28 bp, Artificial Sequence
  PCR primer
  misc_feature (7)..(12): NheI restriction site
gagattgctagctcctacgcaagctttg

SEQ ID NO: 118 - DNA, 12051 bp, Artificial Sequence
  plasmid pLybAL23 containing otsBA operon
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggtcgactctagatggctacgagggcagacagtaagtggatttaccataatcccttaattgtacgcaccgctaaaacgcgttcagcgcgatcacggcagcagacaggtaaaaatggcaacaaaccaccctaaaaactgcgcgatcgcgcctgataaattttaaccgtatgaatacctatgcaaccagagggtacaggccacattacccccacttaatccactgaagctgccatttttcatggtttcaccatcccagcgaagggccatgcatgcatcgaaattaatacgacgaaattaatacgactcactatagggcaattgttatcagctatgcgccgaccagaacaccttgccgatcagccaaacgtctcttcaggccactgactagcgataactttccccacaacggaacaactctcactgcatgggatcattgggtactgtgggtttagtggttgtaaaaacacctgaccgctatccctgatcagtttcttgaaggtaaactcatcacccccaagtctggctatgcagaaatcacctggctcaacagcctgctcagggtcaacgagaattaacattccgtcaggaaagcttggcttggagcctgttggtgcggtcatggaattaccttcaacctcaagccagaatgcagaatcactggctttcttggttgtgcttacccatctctccgcatcacctttggtaaaggttctaagcttaggtgagaacatccctgcctgaacatgagaaaaaacagggtactcatactcacttctaagtgacggctgcatactaaccgcttcatacatctcgtagatttctctggcgattgaagggctaaattcttcaacgctaactttgagaatttttgtaagcaatgcggcgttataagcatttaatgcattgatgccattaaataaagcaccaacgcctgactgccccatccccatcttgtctgcgacagattcctgggataagccaagttcatttttctttttttcataaattgctttaaggcgacgtgcgtcctcaagctgctcttgtgttaatggtttcttttttgtgctcatacgttaaatctatcaccgcaagggataaatatctaacaccgtgcgtgttgactattttacctctggcggtgataatggttgcatcttaagaaggaggatccatatgatcttgatggaacgctggcggaaatcaaaccgcatcccgatcaggtcgtcgtgcctgacaatattctgcaaggactacagctactggcaaccgcaagtgatggtgcattggcattgatatcagggcgctcaatggtggagcttgacgcactggcaaaaccttatcgcttcccgttagcgggcgtgcatggggcggagcgccgtgacatcaatggtaaaacacatatcgttcatctgccggatgcgattgcgcgtgatattagcgtgcaactgcatacagtcatcgctcagtatcccggcgcggagctggaggcgaaagggatggcttttgcgctgcattatcgtcaggctccgcagcatgaagacgcattaatgacattagcgcaacgtattactcagatctggccacaaatggcgttacagcagggaaagtgtgttgtcgagatcaaaccgagaggtaccagtaaaggtgaggcaattgcagcttttatgcaggaagctccctttatcgggcgaacgcccgtatttctgggcgatgatttaaccgatgaatctggcttcgcagtcgttaaccgactgggcggaatgtcagtaaaaattggcacaggtgcaactcaggcatcatggcgactggcgggtgtgccggatgtctggagctggcttgaaatgataaccaccgcattacaacaaaaaagagaaaataacaggagtgatgactatgagtcgtttagtcgtagtatctaaccggattgcaccaccagacgagcacgccgccagtgccggtggccttgccgttggcatactgggggcactgaaagccgcaggcggactgtggtttggctggagtggtgaaacagggaatgaggatcagccgctaaaaaaggtgaaaaaaggtaacattacgtgggcctcttttaacctcagcgaacaggaccttgacgaatactacaaccaattctccaatgccgttctctggcccgcttttcattatcggctcgatctggtgcaatttcagcgtcctgcctgggacggctatctacgcgtaaatgcgttgctggcagataaattactgccgctgttgcaagacgatgacattatctggatccacgattatcacctgttgccatttgcgcatgaattacgcaaacggggagtgaataatcgcattggtttctttctgcatattcctttcccgacaccggaaatcttcaacgcgctgccgacatatgacaccttgcttgaacagctttgtgattatgatttgctgggtttccagacagaaaacgatcgtctggcgttcctggattgtctttctaacctgacccgcgtcacgacacgtagcgcaaaaagccatacagcctggggcaaagcatttcgaacagaagtctacccgatcggcattgaaccgaaagaaatagccaaacaggctgccgggccactgccgccaaaactggcgcaacttaaagcggaactgaaaaacgtacaaaatatcttttctgtcgaacggctggattattccaaaggtttgccagagcgttttctcgcctatgaagcgttgctggaaaaatatccgcagcatcatggtaaaattcgttatacccagattgcaccaacgtcgcgtggtgatgtgcaagcctatcaggatattcgtcatcagctcgaaaatgaagctggacgaattaatggtaaatacgggcaattaggctggacgccgctttattatttgaatcagcattttgaccgtaaattactgatgaaaatattccgctactctgacgtgggcttagtgacgccactgcgtgacgggatgaacctggtagcaaaagagtatgttgctgctcaggacccagccaatccgggcgttcttgttctttcgcaatttgcgggagcggcaaacgagttaacgtcggcgttaattgttaacccctacgatcgtgacgaagttgcagctgcgctggatcgtgcattgactatgtcgctggcggaacgtatttcccgtcatgcagaaatgctggacgttatcgtgaaaaacgatattaaccactggcaggagtgcttcattagcgacctaaagcagatagttccgcgaagcgcggaaagccagcagcgcgataaagttgctacctttccaaagcttgcgtaggagctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 119 - DNA, 23 bp, Artificial Sequence
  PCR primer
ttcattatcggctcgatctggtg

SEQ ID NO: 120 - DNA, 25 bp, Artificial Sequence
  PCR primer
caacaggtgataatcgtggatccag

SEQ ID NO: 121 - DNA, 11348 bp, Artificial Sequence
  plasmid pLybAL28 containing otsBA operon
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgccgttattgatggaatgggaagaagcaatggtcacaataaactggaggttatgggtatgttttttagccctaatgctccaatcgccttgattgtatcgaatgatgcagtctctaaaattgtatccgtaaaagacctctgcaccgccgacgggtctggattatgggcaataatcacagtcgagccagactacccctggaggtaaactccggggctggagccataaagattaggaattcattaagaaatgtaacaatcgacgttctagatcataccacgcccccactgtccggcagggtgaacagaggagactttcccctgttacagtgtcagtgacaaaacaactttttggcatcggtgcaggtggtgagccatggcggcccagatcattgaaattctttccccggaggaaatccgacgtacccttacccgtctggcttcccaggtaatttaggtaccgttaagaaggaggatccatatgatcttgatggaacgctggcggaaatcaaaccgcatcccgatcaggtcgtcgtgcctgacaatattctgcaaggactacagctactggcaaccgcaagtgatggtgcattggcattgatatcagggcgctcaatggtggagcttgacgcactggcaaaaccttatcgcttcccgttagcgggcgtgcatggggcggagcgccgtgacatcaatggtaaaacacatatcgttcatctgccggatgcgattgcgcgtgatattagcgtgcaactgcatacagtcatcgctcagtatcccggcgcggagctggaggcgaaagggatggcttttgcgctgcattatcgtcaggctccgcagcatgaagacgcattaatgacattagcgcaacgtattactcagatctggccacaaatggcgttacagcagggaaagtgtgttgtcgagatcaaaccgagaggtaccagtaaaggtgaggcaattgcagcttttatgcaggaagctccctttatcgggcgaacgcccgtatttctgggcgatgatttaaccgatgaatctggcttcgcagtcgttaaccgactgggcggaatgtcagtaaaaattggcacaggtgcaactcaggcatcatggcgactggcgggtgtgccggatgtctggagctggcttgaaatgataaccaccgcattacaacaaaaaagagaaaataacaggagtgatgactatgagtcgtttagtcgtagtatctaaccggattgcaccaccagacgagcacgccgccagtgccggtggccttgccgttggcatactgggggcactgaaagccgcaggcggactgtggtttggctggagtggtgaaacagggaatgaggatcagccgctaaaaaaggtgaaaaaaggtaacattacgtgggcctcttttaacctcagcgaacaggaccttgacgaatactacaaccaattctccaatgccgttctctggcccgcttttcattatcggctcgatctggtgcaatttcagcgtcctgcctgggacggctatctacgcgtaaatgcgttgctggcagataaattactgccgctgttgcaagacgatgacattatctggatccacgattatcacctgttgccatttgcgcatgaattacgcaaacggggagtgaataatcgcattggtttctttctgcatattcctttcccgacaccggaaatcttcaacgcgctgccgacatatgacaccttgcttgaacagctttgtgattatgatttgctgggtttccagacagaaaacgatcgtctggcgttcctggattgtctttctaacctgacccgcgtcacgacacgtagcgcaaaaagccatacagcctggggcaaagcatttcgaacagaagtctacccgatcggcattgaaccgaaagaaatagccaaacaggctgccgggccactgccgccaaaactggcgcaacttaaagcggaactgaaaaacgtacaaaatatcttttctgtcgaacggctggattattccaaaggtttgccagagcgttttctcgcctatgaagcgttgctggaaaaatatccgcagcatcatggtaaaattcgttatacccagattgcaccaacgtcgcgtggtgatgtgcaagcctatcaggatattcgtcatcagctcgaaaatgaagctggacgaattaatggtaaatacgggcaattaggctggacgccgctttattatttgaatcagcattttgaccgtaaattactgatgaaaatattccgctactctgacgtgggcttagtgacgccactgcgtgacgggatgaacctggtagcaaaagagtatgttgctgctcaggacccagccaatccgggcgttcttgttctttcgcaatttgcgggagcggcaaacgagttaacgtcggcgttaattgttaacccctacgatcgtgacgaagttgcagctgcgctggatcgtgcattgactatgtcgctggcggaacgtatttcccgtcatgcagaaatgctggacgttatcgtgaaaaacgatattaaccactggcaggagtgcttcattagcgacctaaagcagatagttccgcgaagcgcggaaagccagcagcgcgataaagttgctacctttccaaagcttgcgtaggagctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 122 - DNA, 11527 bp, Artificial Sequence
  plasmid pLybAL29 containing otsBA operon
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgccgagcctgatgtgtgacacctaagatcactccagttctctttggaaactggctgatgagtgaagacaccatctttggcaagatcatccggcgcgagattccagcagacattgtttatgaagatgatctctgtctggcttttcgagatgtggcaccccaagcgccggttcacattctggtgattcccaagcaaccaattgccaaccttttggaagcgacagcagaacatcaagcgctgctgggtcatttgttgctgactgtaaaggcgatcgcggcccaagaaggactcaccgagggctaccgcaccgtgattaacacgggccctgcgggtgggcaaaccgtttaccacctgcatattcacttactgggcgggcgatcgctggcttggccgcccggctgagaaaagtctgaaagttctttacaaaactcaatctgcttgttagattttactcacgaggctattaagtctcgtaaatagttcaactaaggactcatcgcaaaatgacgactgcattgcagcggcgcgagagcgccagcctgtggcagcagttctgcgagtgggtaaccagcaccgacaaccgcctctatgtgggttggttcggcgtgctgatgatccccactctgctgaccggtaccgttaagaaggaggatccatatgatcttgatggaacgctggcggaaatcaaaccgcatcccgatcaggtcgtcgtgcctgacaatattctgcaaggactacagctactggcaaccgcaagtgatggtgcattggcattgatatcagggcgctcaatggtggagcttgacgcactggcaaaaccttatcgcttcccgttagcgggcgtgcatggggcggagcgccgtgacatcaatggtaaaacacatatcgttcatctgccggatgcgattgcgcgtgatattagcgtgcaactgcatacagtcatcgctcagtatcccggcgcggagctggaggcgaaagggatggcttttgcgctgcattatcgtcaggctccgcagcatgaagacgcattaatgacattagcgcaacgtattactcagatctggccacaaatggcgttacagcagggaaagtgtgttgtcgagatcaaaccgagaggtaccagtaaaggtgaggcaattgcagcttttatgcaggaagctccctttatcgggcgaacgcccgtatttctgggcgatgatttaaccgatgaatctggcttcgcagtcgttaaccgactgggcggaatgtcagtaaaaattggcacaggtgcaactcaggcatcatggcgactggcgggtgtgccggatgtctggagctggcttgaaatgataaccaccgcattacaacaaaaaagagaaaataacaggagtgatgactatgagtcgtttagtcgtagtatctaaccggattgcaccaccagacgagcacgccgccagtgccggtggccttgccgttggcatactgggggcactgaaagccgcaggcggactgtggtttggctggagtggtgaaacagggaatgaggatcagccgctaaaaaaggtgaaaaaaggtaacattacgtgggcctcttttaacctcagcgaacaggaccttgacgaatactacaaccaattctccaatgccgttctctggcccgcttttcattatcggctcgatctggtgcaatttcagcgtcctgcctgggacggctatctacgcgtaaatgcgttgctggcagataaattactgccgctgttgcaagacgatgacattatctggatccacgattatcacctgttgccatttgcgcatgaattacgcaaacggggagtgaataatcgcattggtttctttctgcatattcctttcccgacaccggaaatcttcaacgcgctgccgacatatgacaccttgcttgaacagctttgtgattatgatttgctgggtttccagacagaaaacgatcgtctggcgttcctggattgtctttctaacctgacccgcgtcacgacacgtagcgcaaaaagccatacagcctggggcaaagcatttcgaacagaagtctacccgatcggcattgaaccgaaagaaatagccaaacaggctgccgggccactgccgccaaaactggcgcaacttaaagcggaactgaaaaacgtacaaaatatcttttctgtcgaacggctggattattccaaaggtttgccagagcgttttctcgcctatgaagcgttgctggaaaaatatccgcagcatcatggtaaaattcgttatacccagattgcaccaacgtcgcgtggtgatgtgcaagcctatcaggatattcgtcatcagctcgaaaatgaagctggacgaattaatggtaaatacgggcaattaggctggacgccgctttattatttgaatcagcattttgaccgtaaattactgatgaaaatattccgctactctgacgtgggcttagtgacgccactgcgtgacgggatgaacctggtagcaaaagagtatgttgctgctcaggacccagccaatccgggcgttcttgttctttcgcaatttgcgggagcggcaaacgagttaacgtcggcgttaattgttaacccctacgatcgtgacgaagttgcagctgcgctggatcgtgcattgactatgtcgctggcggaacgtatttcccgtcatgcagaaatgctggacgttatcgtgaaaaacgatattaaccactggcaggagtgcttcattagcgacctaaagcagatagttccgcgaagcgcggaaagccagcagcgcgataaagttgctacctttccaaagcttgcgtaggagctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 123 - DNA, 11769 bp, Artificial Sequence
  plasmid pLybAL30 containing otsBA operon
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcaccagtaaacataaatctccccggcgacgcaaaaaacgggtgaccatcaagccggtgcgcttcggcatttttctgctttgcctagcaggcattgtggggggggcaactgccctaattatcaatcgtactggcgatcccctaggtgggttgctagaagaccccctagatgttttcctggaccaaccttcagaatttatccccgatgaagccacgagccggaatttgattctcagtcaacccaacttcaatcagcaagtgggtcagatggtagtacaaggctggcttgatagtaaaaagttagcctttggccaaaactacgatgtcggggcattgcagagtgttttagcccccaatctccttgcccaacaacggggtcgggcccaacgggatcaagcccaaaaggtctatcaccaatacgaacacaagttgcagattttagcctatcaagttaacccccaagaccccaaccgagccaccgttactgcccgggtagaagaaattagccagccctttaccctaggtaatcaacagcagaagggctccgccaccaaagatgacttgactgtgcgctatcagctagtacgacaccaaggggtttggaaaattgaccaaatacaagtggtaaatggcccccgttagtgcgtggcgttaactccccttttgaccaatggcatacggctagatgcccccataggtacggaaacctgcacttccgagaactaagcccctaccgtcactataagagtgtgaacgtgtcggccccaggcaatggattggaaccatggcttttcggcccatcgttgtgtcttatattcttacttgttaacgggagttaattaaaattatgggaaaagttgttgggattgacctcggtaccgttaagaaggaggatccatatgatcttgatggaacgctggcggaaatcaaaccgcatcccgatcaggtcgtcgtgcctgacaatattctgcaaggactacagctactggcaaccgcaagtgatggtgcattggcattgatatcagggcgctcaatggtggagcttgacgcactggcaaaaccttatcgcttcccgttagcgggcgtgcatggggcggagcgccgtgacatcaatggtaaaacacatatcgttcatctgccggatgcgattgcgcgtgatattagcgtgcaactgcatacagtcatcgctcagtatcccggcgcggagctggaggcgaaagggatggcttttgcgctgcattatcgtcaggctccgcagcatgaagacgcattaatgacattagcgcaacgtattactcagatctggccacaaatggcgttacagcagggaaagtgtgttgtcgagatcaaaccgagaggtaccagtaaaggtgaggcaattgcagcttttatgcaggaagctccctttatcgggcgaacgcccgtatttctgggcgatgatttaaccgatgaatctggcttcgcagtcgttaaccgactgggcggaatgtcagtaaaaattggcacaggtgcaactcaggcatcatggcgactggcgggtgtgccggatgtctggagctggcttgaaatgataaccaccgcattacaacaaaaaagagaaaataacaggagtgatgactatgagtcgtttagtcgtagtatctaaccggattgcaccaccagacgagcacgccgccagtgccggtggccttgccgttggcatactgggggcactgaaagccgcaggcggactgtggtttggctggagtggtgaaacagggaatgaggatcagccgctaaaaaaggtgaaaaaaggtaacattacgtgggcctcttttaacctcagcgaacaggaccttgacgaatactacaaccaattctccaatgccgttctctggcccgcttttcattatcggctcgatctggtgcaatttcagcgtcctgcctgggacggctatctacgcgtaaatgcgttgctggcagataaattactgccgctgttgcaagacgatgacattatctggatccacgattatcacctgttgccatttgcgcatgaattacgcaaacggggagtgaataatcgcattggtttctttctgcatattcctttcccgacaccggaaatcttcaacgcgctgccgacatatgacaccttgcttgaacagctttgtgattatgatttgctgggtttccagacagaaaacgatcgtctggcgttcctggattgtctttctaacctgacccgcgtcacgacacgtagcgcaaaaagccatacagcctggggcaaagcatttcgaacagaagtctacccgatcggcattgaaccgaaagaaatagccaaacaggctgccgggccactgccgccaaaactggcgcaacttaaagcggaactgaaaaacgtacaaaatatcttttctgtcgaacggctggattattccaaaggtttgccagagcgttttctcgcctatgaagcgttgctggaaaaatatccgcagcatcatggtaaaattcgttatacccagattgcaccaacgtcgcgtggtgatgtgcaagcctatcaggatattcgtcatcagctcgaaaatgaagctggacgaattaatggtaaatacgggcaattaggctggacgccgctttattatttgaatcagcattttgaccgtaaattactgatgaaaatattccgctactctgacgtgggcttagtgacgccactgcgtgacgggatgaacctggtagcaaaagagtatgttgctgctcaggacccagccaatccgggcgttcttgttctttcgcaatttgcgggagcggcaaacgagttaacgtcggcgttaattgttaacccctacgatcgtgacgaagttgcagctgcgctggatcgtgcattgactatgtcgctggcggaacgtatttcccgtcatgcagaaatgctggacgttatcgtgaaaaacgatattaaccactggcaggagtgcttcattagcgacctaaagcagatagttccgcgaagcgcggaaagccagcagcgcgataaagttgctacctttccaaagcttgcgtaggagctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 124 - DNA, 11477 bp, Artificial Sequence
  plasmid pLybAL31 containing otsBA operon
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcaaagctcactaactgggcgggattttccgggtccggttgctgacggtaatagtcgtctaaaagtttggccacatccaaaaggctgtcggcggggggatgctggccggcgaggggattaattctgcttgtcatatacaaaaattgtaaaaaatggagggcggcgatcaggggcttagacacccaaatcctagccaaaaagggttaactagccaagggctatccatgggcaaagagataaaagaaaaagtctccaaatccctggtcatagagaaaaaattgccaaagttaccccaggccatacacggcccagcgccaagatggggagcacaaattcaaactttgtaaacaggccggaagctatccggccaaggagcactcagattgtgttaacgttcaggggagttgcttaacacaattttccaattaatagtattaatattttcttaacttgcaccgtaccatggtgagaaagcctatctgagcccttatttgattaaccttcgactgattattgatcccctgtgcagtctcccctctccctctgtctttttgctcccgaacacgttgcccatagactcaggtaccgttaagaaggaggatccatatgatcttgatggaacgctggcggaaatcaaaccgcatcccgatcaggtcgtcgtgcctgacaatattctgcaaggactacagctactggcaaccgcaagtgatggtgcattggcattgatatcagggcgctcaatggtggagcttgacgcactggcaaaaccttatcgcttcccgttagcgggcgtgcatggggcggagcgccgtgacatcaatggtaaaacacatatcgttcatctgccggatgcgattgcgcgtgatattagcgtgcaactgcatacagtcatcgctcagtatcccggcgcggagctggaggcgaaagggatggcttttgcgctgcattatcgtcaggctccgcagcatgaagacgcattaatgacattagcgcaacgtattactcagatctggccacaaatggcgttacagcagggaaagtgtgttgtcgagatcaaaccgagaggtaccagtaaaggtgaggcaattgcagcttttatgcaggaagctccctttatcgggcgaacgcccgtatttctgggcgatgatttaaccgatgaatctggcttcgcagtcgttaaccgactgggcggaatgtcagtaaaaattggcacaggtgcaactcaggcatcatggcgactggcgggtgtgccggatgtctggagctggcttgaaatgataaccaccgcattacaacaaaaaagagaaaataacaggagtgatgactatgagtcgtttagtcgtagtatctaaccggattgcaccaccagacgagcacgccgccagtgccggtggccttgccgttggcatactgggggcactgaaagccgcaggcggactgtggtttggctggagtggtgaaacagggaatgaggatcagccgctaaaaaaggtgaaaaaaggtaacattacgtgggcctcttttaacctcagcgaacaggaccttgacgaatactacaaccaattctccaatgccgttctctggcccgcttttcattatcggctcgatctggtgcaatttcagcgtcctgcctgggacggctatctacgcgtaaatgcgttgctggcagataaattactgccgctgttgcaagacgatgacattatctggatccacgattatcacctgttgccatttgcgcatgaattacgcaaacggggagtgaataatcgcattggtttctttctgcatattcctttcccgacaccggaaatcttcaacgcgctgccgacatatgacaccttgcttgaacagctttgtgattatgatttgctgggtttccagacagaaaacgatcgtctggcgttcctggattgtctttctaacctgacccgcgtcacgacacgtagcgcaaaaagccatacagcctggggcaaagcatttcgaacagaagtctacccgatcggcattgaaccgaaagaaatagccaaacaggctgccgggccactgccgccaaaactggcgcaacttaaagcggaactgaaaaacgtacaaaatatcttttctgtcgaacggctggattattccaaaggtttgccagagcgttttctcgcctatgaagcgttgctggaaaaatatccgcagcatcatggtaaaattcgttatacccagattgcaccaacgtcgcgtggtgatgtgcaagcctatcaggatattcgtcatcagctcgaaaatgaagctggacgaattaatggtaaatacgggcaattaggctggacgccgctttattatttgaatcagcattttgaccgtaaattactgatgaaaatattccgctactctgacgtgggcttagtgacgccactgcgtgacgggatgaacctggtagcaaaagagtatgttgctgctcaggacccagccaatccgggcgttcttgttctttcgcaatttgcgggagcggcaaacgagttaacgtcggcgttaattgttaacccctacgatcgtgacgaagttgcagctgcgctggatcgtgcattgactatgtcgctggcggaacgtatttcccgtcatgcagaaatgctggacgttatcgtgaaaaacgatattaaccactggcaggagtgcttcattagcgacctaaagcagatagttccgcgaagcgcggaaagccagcagcgcgataaagttgctacctttccaaagcttgcgtaggagctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 125 - DNA, 11258 bp, Artificial Sequence
  plasmid pLybAL36 containing otsBA operon
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcaggaaaacaagctcagaatgctgcggggagaagggcaactccccaccagccccaaatttttgctggcgataaatatttttcggtttaattgttcacaaagctttttgaatttgagtttatagaaatttattggctggtaatgcttttttgcccccctgcaggacttcattgatccttgcctataccatcaatatcattggtcaataatgatgatgattgactaaaacatgtttaacaaaatttaacgcatatgctaaatgcgtaaactgcatatgccttggctgagtgtaatttacgttacaaattttaacgaaacgggaaccctatattgatctctactgttatctggcttgaagcgttggtaccgttaagaaggaggatccatatgatcttgatggaacgctggcggaaatcaaaccgcatcccgatcaggtcgtcgtgcctgacaatattctgcaaggactacagctactggcaaccgcaagtgatggtgcattggcattgatatcagggcgctcaatggtggagcttgacgcactggcaaaaccttatcgcttcccgttagcgggcgtgcatggggcggagcgccgtgacatcaatggtaaaacacatatcgttcatctgccggatgcgattgcgcgtgatattagcgtgcaactgcatacagtcatcgctcagtatcccggcgcggagctggaggcgaaagggatggcttttgcgctgcattatcgtcaggctccgcagcatgaagacgcattaatgacattagcgcaacgtattactcagatctggccacaaatggcgttacagcagggaaagtgtgttgtcgagatcaaaccgagaggtaccagtaaaggtgaggcaattgcagcttttatgcaggaagctccctttatcgggcgaacgcccgtatttctgggcgatgatttaaccgatgaatctggcttcgcagtcgttaaccgactgggcggaatgtcagtaaaaattggcacaggtgcaactcaggcatcatggcgactggcgggtgtgccggatgtctggagctggcttgaaatgataaccaccgcattacaacaaaaaagagaaaataacaggagtgatgactatgagtcgtttagtcgtagtatctaaccggattgcaccaccagacgagcacgccgccagtgccggtggccttgccgttggcatactgggggcactgaaagccgcaggcggactgtggtttggctggagtggtgaaacagggaatgaggatcagccgctaaaaaaggtgaaaaaaggtaacattacgtgggcctcttttaacctcagcgaacaggaccttgacgaatactacaaccaattctccaatgccgttctctggcccgcttttcattatcggctcgatctggtgcaatttcagcgtcctgcctgggacggctatctacgcgtaaatgcgttgctggcagataaattactgccgctgttgcaagacgatgacattatctggatccacgattatcacctgttgccatttgcgcatgaattacgcaaacggggagtgaataatcgcattggtttctttctgcatattcctttcccgacaccggaaatcttcaacgcgctgccgacatatgacaccttgcttgaacagctttgtgattatgatttgctgggtttccagacagaaaacgatcgtctggcgttcctggattgtctttctaacctgacccgcgtcacgacacgtagcgcaaaaagccatacagcctggggcaaagcatttcgaacagaagtctacccgatcggcattgaaccgaaagaaatagccaaacaggctgccgggccactgccgccaaaactggcgcaacttaaagcggaactgaaaaacgtacaaaatatcttttctgtcgaacggctggattattccaaaggtttgccagagcgttttctcgcctatgaagcgttgctggaaaaatatccgcagcatcatggtaaaattcgttatacccagattgcaccaacgtcgcgtggtgatgtgcaagcctatcaggatattcgtcatcagctcgaaaatgaagctggacgaattaatggtaaatacgggcaattaggctggacgccgctttattatttgaatcagcattttgaccgtaaattactgatgaaaatattccgctactctgacgtgggcttagtgacgccactgcgtgacgggatgaacctggtagcaaaagagtatgttgctgctcaggacccagccaatccgggcgttcttgttctttcgcaatttgcgggagcggcaaacgagttaacgtcggcgttaattgttaacccctacgatcgtgacgaagttgcagctgcgctggatcgtgcattgactatgtcgctggcggaacgtatttcccgtcatgcagaaatgctggacgttatcgtgaaaaacgatattaaccactggcaggagtgcttcattagcgacctaaagcagatagttccgcgaagcgcggaaagccagcagcgcgataaagttgctacctttccaaagcttgcgtaggagctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 126 - DNA, 11453 bp, Artificial Sequence
  plasmid pLybAL37 containing otsBA operon
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcataaatttctgttttgaccaaaccatcccgacataactcggtcagggcttgcaaaacagcggggatgcgatcgtgctgccagagactgcaaaggtgagccaataaccactgcgtctgccagtcatcaggtatcgcttggcagcgctgcaacccagcttcgaggacgcgaacatcaactgttttggccagttgctgaacctgtcgccaacaatgttcaaaatcaccgcttggccagccgtcactctctgcaaacgctgcatcagtcatgtgcaatcaatacaggttaaaaaccatgctaatggctccacctaagcgggcttcagagtcaaggcttgtagcaattgctactaaaaactgcgatcgctgctgaaatgagctggaattctgtccctctcagctcaaaaagtatcaatgattacttaatgtttgttctgcgcaaacttcttgcagaacatgcatgatttacaaaaagttgtagtttctgttaccaattgcgaatcgagaactgcctaatctgccgagtatgcaagctgctttgtaggcagatgaatccatggtaccgttaagaaggaggatccatatgatcttgatggaacgctggcggaaatcaaaccgcatcccgatcaggtcgtcgtgcctgacaatattctgcaaggactacagctactggcaaccgcaagtgatggtgcattggcattgatatcagggcgctcaatggtggagcttgacgcactggcaaaaccttatcgcttcccgttagcgggcgtgcatggggcggagcgccgtgacatcaatggtaaaacacatatcgttcatctgccggatgcgattgcgcgtgatattagcgtgcaactgcatacagtcatcgctcagtatcccggcgcggagctggaggcgaaagggatggcttttgcgctgcattatcgtcaggctccgcagcatgaagacgcattaatgacattagcgcaacgtattactcagatctggccacaaatggcgttacagcagggaaagtgtgttgtcgagatcaaaccgagaggtaccagtaaaggtgaggcaattgcagcttttatgcaggaagctccctttatcgggcgaacgcccgtatttctgggcgatgatttaaccgatgaatctggcttcgcagtcgttaaccgactgggcggaatgtcagtaaaaattggcacaggtgcaactcaggcatcatggcgactggcgggtgtgccggatgtctggagctggcttgaaatgataaccaccgcattacaacaaaaaagagaaaataacaggagtgatgactatgagtcgtttagtcgtagtatctaaccggattgcaccaccagacgagcacgccgccagtgccggtggccttgccgttggcatactgggggcactgaaagccgcaggcggactgtggtttggctggagtggtgaaacagggaatgaggatcagccgctaaaaaaggtgaaaaaaggtaacattacgtgggcctcttttaacctcagcgaacaggaccttgacgaatactacaaccaattctccaatgccgttctctggcccgcttttcattatcggctcgatctggtgcaatttcagcgtcctgcctgggacggctatctacgcgtaaatgcgttgctggcagataaattactgccgctgttgcaagacgatgacattatctggatccacgattatcacctgttgccatttgcgcatgaattacgcaaacggggagtgaataatcgcattggtttctttctgcatattcctttcccgacaccggaaatcttcaacgcgctgccgacatatgacaccttgcttgaacagctttgtgattatgatttgctgggtttccagacagaaaacgatcgtctggcgttcctggattgtctttctaacctgacccgcgtcacgacacgtagcgcaaaaagccatacagcctggggcaaagcatttcgaacagaagtctacccgatcggcattgaaccgaaagaaatagccaaacaggctgccgggccactgccgccaaaactggcgcaacttaaagcggaactgaaaaacgtacaaaatatcttttctgtcgaacggctggattattccaaaggtttgccagagcgttttctcgcctatgaagcgttgctggaaaaatatccgcagcatcatggtaaaattcgttatacccagattgcaccaacgtcgcgtggtgatgtgcaagcctatcaggatattcgtcatcagctcgaaaatgaagctggacgaattaatggtaaatacgggcaattaggctggacgccgctttattatttgaatcagcattttgaccgtaaattactgatgaaaatattccgctactctgacgtgggcttagtgacgccactgcgtgacgggatgaacctggtagcaaaagagtatgttgctgctcaggacccagccaatccgggcgttcttgttctttcgcaatttgcgggagcggcaaacgagttaacgtcggcgttaattgttaacccctacgatcgtgacgaagttgcagctgcgctggatcgtgcattgactatgtcgctggcggaacgtatttcccgtcatgcagaaatgctggacgttatcgtgaaaaacgatattaaccactggcaggagtgcttcattagcgacctaaagcagatagttccgcgaagcgcggaaagccagcagcgcgataaagttgctacctttccaaagcttgcgtaggagctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 127 - DNA, 1754 bp, Artificial Sequence
  PCR product
  misc_feature (7)..(12): AflII restriction site
  misc_feature (1743)..(1748): XbaI restriction site
tattcgcttaagccaaaggagaatgattgatgaaatcccccgcaccttctcgcccgcaaaaaatggcgttaattccagcctgtatctttttgtgtttcgctgcgctatcggtgcaggcagaagaaacaccggtaacaccacagccgcctgatattttattagggccgctgtttaatgatgtgcaaaacgccaaactttttccggaccaaaaaacctttgccgatgccgtgccgaacagcgatccgctgatgatccttgctgattatcggatgcagcaaaaccagagcggatttgatctgcgccatttcgttaacgtcaatttcaccctgccgaaagaaggcgagaaatatgttccgccagaggggcagtcactgcgcgaacatattgacggactttggccggtattaacgcgttctaccgaaaacaccgaaaaatgggattctctgttaccgctgccggaaccttatgtcgtgccgggcggacgctttcgcgaggtatattactgggacagttacttcaccatgttaggacttgccgaaagcggtcactgggataaagtcgcggatatggtggccaattttgctcatgaaatagacacttacggtcatattcccaacggcaaccgcagttactatttaagccgctcgcaaccgcccttctttgccctgatggtagagttactggcgcagcatgaaggcgatgccgcgttgaagcaatacctgccgcaaatgcaaaaagaatatgcttactggatggacggtgttgaaaacctgcaagccggacaacaggaaaaacgcgttgtcaaacttcaggatggtacccttctcaaccgctactgggacgatcgcgatacgccacgaccagagtcatgggtggaagatattgccaccgccaaaagcaatccgaatcgacctgccactgaaatttaccgcgacctgcgctctgccgctgcgtctggctgggatttcagctcgcgctggatggacaacccgcagcagttaaataccttacgcaccaccagcatcgtaccggtcgatctgaacagcctgatgtttaaaatggaaaaaatcctcgcccgcgccagcaaagctgccggagataacgcgatggcaaaccagtacgaaacgctggcaaatgcccgtcaaaaagggatcgaaaaatacctgtggaacgatcaacaaggctggtatgccgattacgacctgaaaagtcataaagtgcgcaatcagttaaccgcggccgccctgttcccgctgtacgtcaatgcggcagcgaaagatcgcgccaacaaaatggcgacggcgacgaaaacacatctgctgcaacccggcggcctgaacaccacgtcggtgaaaagtgggcaacaatgggatgcgccaaatggctgggcaccgttacagtgggtcgcgacagaaggattacaaaactacgggcaaaaagaggtggcgatggacattagctggcacttcctgaccaatgttcagcacacctatgaccgggagaaaaagctggtggaaaaatatgatgtcagcaccaccggaacggggggcggcggtggcgaatatccattacaggatggctttggctggaccaatggcgtgacgctgaaaatgctggatttgatctgcccgaaagagcaaccgtgtgacaatgttccggcgacgcgtccgaccgttaagtcagcaacgacgcaaccctcaaccaaagaggcacaacccacaccttaaccagcgcttactccgtctagatcattc

SEQ ID NO: 128 - DNA, 29 bp, Artificial Sequence
  PCR primer
  misc_feature (7)..(12): AflII restriction site
tattcgcttaagccaaaggagaatgattg

SEQ ID NO: 129 - DNA, 27 bp, Artificial Sequence
  PCR primer
  misc_feature (7)..(12): XbaI restriction site
gaatgatctagacggagtaagcgctgg

SEQ ID NO: 130 - DNA, 6282 bp, Artificial Sequence
  plasmid pLybAL24 containing treA
tagtcatgccccgcgcccaccggaaggagctgactgggttgaaggctctcaagggcatcggtcgataaatattctgaaatgagctgttgacaattaatcatcgaactagttaacttttacgcaagttcttaagccaaaggagaatgattgatgaaatcccccgcaccttctcgcccgcaaaaaatggcgttaattccagcctgtatctttttgtgtttcgctgcgctatcggtgcaggcagaagaaacaccggtaacaccacagccgcctgatattttattagggccgctgtttaatgatgtgcaaaacgccaaactttttccggaccaaaaaacctttgccgatgccgtgccgaacagcgatccgctgatgatccttgctgattatcggatgcagcaaaaccagagcggatttgatctgcgccatttcgttaacgtcaatttcaccctgccgaaagaaggcgagaaatatgttccgccagaggggcagtcactgcgcgaacatattgacggactttggccggtattaacgcgttctaccgaaaacaccgaaaaatgggattctctgttaccgctgccggaaccttatgtcgtgccgggcggacgctttcgcgaggtatattactgggacagttacttcaccatgttaggacttgccgaaagcggtcactgggataaagtcgcggatatggtggccaattttgctcatgaaatagacacttacggtcatattcccaacggcaaccgcagttactatttaagccgctcgcaaccgcccttctttgccctgatggtagagttactggcgcagcatgaaggcgatgccgcgttgaagcaatacctgccgcaaatgcaaaaagaatatgcttactggatggacggtgttgaaaacctgcaagccggacaacaggaaaaacgcgttgtcaaacttcaggatggtacccttctcaaccgctactgggacgatcgcgatacgccacgaccagagtcatgggtggaagatattgccaccgccaaaagcaatccgaatcgacctgccactgaaatttaccgcgacctgcgctctgccgctgcgtctggctgggatttcagctcgcgctggatggacaacccgcagcagttaaataccttacgcaccaccagcatcgtaccggtcgatctgaacagcctgatgtttaaaatggaaaaaatcctcgcccgcgccagcaaagctgccggagataacgcgatggcaaaccagtacgaaacgctggcaaatgcccgtcaaaaagggatcgaaaaatacctgtggaacgatcaacaaggctggtatgccgattacgacctgaaaagtcataaagtgcgcaatcagttaaccgcggccgccctgttcccgctgtacgtcaatgcggcagcgaaagatcgcgccaacaaaatggcgacggcgacgaaaacacatctgctgcaacccggcggcctgaacaccacgtcggtgaaaagtgggcaacaatgggatgcgccaaatggctgggcaccgttacagtgggtcgcgacagaaggattacaaaactacgggcaaaaagaggtggcgatggacattagctggcacttcctgaccaatgttcagcacacctatgaccgggagaaaaagctggtggaaaaatatgatgtcagcaccaccggaacggggggcggcggtggcgaatatccattacaggatggctttggctggaccaatggcgtgacgctgaaaatgctggatttgatctgcccgaaagagcaaccgtgtgacaatgttccggcgacgcgtccgaccgttaagtcagcaacgacgcaaccctcaaccaaagaggcacaacccacaccttaaccagcgcttactccgtctagacatcaccatcaccatcattaattaagtttgtgtttaaactgcaggcatgcaagcttctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgaaaaaaaatccttacgtttcgctaaggatgtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcacttgatgcctccgtgtaagggggaatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgctcgatggctacgagggcagacagtaagtggatttaccataatcccttaattgtacgcaccgctaaaacgcgttcagcgcgatcacggcagcagacaggtaaaaatggcaacaaaccaccctaaaaactgcgcgatcgcgcctgataaattttaaccgtatgaatacctatgcaaccagagggtacaggccacattacccccacttaatccactgaagctgccatttttcatggtttcaccatcccagcgaagggccatgcatgcatcgaaattaatacgacgaaattaatacgactcactatagggcaatt

SEQ ID NO: 131 - DNA, 27 bp, Artificial Sequence
  PCR primer
  misc_feature (9)..(14): AflII restriction site
cgcaagttcttaagccaaaggagaatg

SEQ ID NO: 132 - DNA, 26 bp, Artificial Sequence
  PCR primer
  misc_feature (7)..(12): XbaI restriction site
aagcgctctagaaggtgtgggttgtg

SEQ ID NO: 133 - DNA, 6264 bp, Artificial Sequence
  plasmid pLybAL33 containing 6-His tagged treA
tagtcatgccccgcgcccaccggaaggagctgactgggttgaaggctctcaagggcatcggtcgataaatattctgaaatgagctgttgacaattaatcatcgaactagttaacttttacgcaagttcttaagccaaaggagaatgattgatgaaatcccccgcaccttctcgcccgcaaaaaatggcgttaattccagcctgtatctttttgtgtttcgctgcgctatcggtgcaggcagaagaaacaccggtaacaccacagccgcctgatattttattagggccgctgtttaatgatgtgcaaaacgccaaactttttccggaccaaaaaacctttgccgatgccgtgccgaacagcgatccgctgatgatccttgctgattatcggatgcagcaaaaccagagcggatttgatctgcgccatttcgttaacgtcaatttcaccctgccgaaagaaggcgagaaatatgttccgccagaggggcagtcactgcgcgaacatattgacggactttggccggtattaacgcgttctaccgaaaacaccgaaaaatgggattctctgttaccgctgccggaaccttatgtcgtgccgggcggacgctttcgcgaggtatattactgggacagttacttcaccatgttaggacttgccgaaagcggtcactgggataaagtcgcggatatggtggccaattttgctcatgaaatagacacttacggtcatattcccaacggcaaccgcagttactatttaagccgctcgcaaccgcccttctttgccctgatggtagagttactggcgcagcatgaaggcgatgccgcgttgaagcaatacctgccgcaaatgcaaaaagaatatgcttactggatggacggtgttgaaaacctgcaagccggacaacaggaaaaacgcgttgtcaaacttcaggatggtacccttctcaaccgctactgggacgatcgcgatacgccacgaccagagtcatgggtggaagatattgccaccgccaaaagcaatccgaatcgacctgccactgaaatttaccgcgacctgcgctctgccgctgcgtctggctgggatttcagctcgcgctggatggacaacccgcagcagttaaataccttacgcaccaccagcatcgtaccggtcgatctgaacagcctgatgtttaaaatggaaaaaatcctcgcccgcgccagcaaagctgccggagataacgcgatggcaaaccagtacgaaacgctggcaaatgcccgtcaaaaagggatcgaaaaatacctgtggaacgatcaacaaggctggtatgccgattacgacctgaaaagtcataaagtgcgcaatcagttaaccgcggccgccctgttcccgctgtacgtcaatgcggcagcgaaagatcgcgccaacaaaatggcgacggcgacgaaaacacatctgctgcaacccggcggcctgaacaccacgtcggtgaaaagtgggcaacaatgggatgcgccaaatggctgggcaccgttacagtgggtcgcgacagaaggattacaaaactacgggcaaaaagaggtggcgatggacattagctggcacttcctgaccaatgttcagcacacctatgaccgggagaaaaagctggtggaaaaatatgatgtcagcaccaccggaacggggggcggcggtggcgaatatccattacaggatggctttggctggaccaatggcgtgacgctgaaaatgctggatttgatctgcccgaaagagcaaccgtgtgacaatgttccggcgacgcgtccgaccgttaagtcagcaacgacgcaaccctcaaccaaagaggcacaacccacaccttctagacatcaccatcaccatcattaattaagtttgtgtttaaactgcaggcatgcaagcttctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgaaaaaaaatccttacgtttcgctaaggatgtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcacttgatgcctccgtgtaagggggaatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccagtgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgacgctctcccttatgcgactcctgcattaggaagcagcccagtagtaggttgaggccgttgagcaccgccgccgcaaggaatggtgcatgctcgatggctacgagggcagacagtaagtggatttaccataatcccttaattgtacgcaccgctaaaacgcgttcagcgcgatcacggcagcagacaggtaaaaatggcaacaaaccaccctaaaaactgcgcgatcgcgcctgataaattttaaccgtatgaatacctatgcaaccagagggtacaggccacattacccccacttaatccactgaagctgccatttttcatggtttcaccatcccagcgaagggccatgcatgcatcgaaattaatacgacgaaattaatacgactcactatagggcaatt

SEQ ID NO: 134 - DNA, 1698 bp, Escherichia coli
atgaaatcccccgcaccttctcgcccgcaaaaaatggcgttaattccagcctgtatctttttgtgtttcgctgcgctatcggtgcaggcagaagaaacaccggtaacaccacagccgcctgatattttattagggccgctgtttaatgatgtgcaaaacgccaaactttttccggaccaaaaaacctttgccgatgccgtgccgaacagcgatccgctgatgatccttgctgattatcggatgcagcaaaaccagagcggatttgatctgcgccatttcgttaacgtcaatttcaccctgccgaaagaaggcgagaaatatgttccgccagaggggcagtcactgcgcgaacatattgacggactttggccggtattaacgcgttctaccgaaaacaccgaaaaatgggattctctgttaccgctgccggaaccttatgtcgtgccgggcggacgctttcgcgaggtatattactgggacagttacttcaccatgttaggacttgccgaaagcggtcactgggataaagtcgcggatatggtggccaattttgctcatgaaatagacacttacggtcatattcccaacggcaaccgcagttactatttaagccgctcgcaaccgcccttctttgccctgatggtagagttactggcgcagcatgaaggcgatgccgcgttgaagcaatacctgccgcaaatgcaaaaagaatatgcttactggatggacggtgttgaaaacctgcaagccggacaacaggaaaaacgcgttgtcaaacttcaggatggtacccttctcaaccgctactgggacgatcgcgatacgccacgaccagagtcatgggtggaagatattgccaccgccaaaagcaatccgaatcgacctgccactgaaatttaccgcgacctgcgctctgccgctgcgtctggctgggatttcagctcgcgctggatggacaacccgcagcagttaaataccttacgcaccaccagcatcgtaccggtcgatctgaacagcctgatgtttaaaatggaaaaaatcctcgcccgcgccagcaaagctgccggagataacgcgatggcaaaccagtacgaaacgctggcaaatgcccgtcaaaaagggatcgaaaaatacctgtggaacgatcaacaaggctggtatgccgattacgacctgaaaagtcataaagtgcgcaatcagttaaccgcggccgccctgttcccgctgtacgtcaatgcggcagcgaaagatcgcgccaacaaaatggcgacggcgacgaaaacacatctgctgcaacccggcggcctgaacaccacgtcggtgaaaagtgggcaacaatgggatgcgccaaatggctgggcaccgttacagtgggtcgcgacagaaggattacaaaactacgggcaaaaagaggtggcgatggacattagctggcacttcctgaccaatgttcagcacacctatgaccgggagaaaaagctggtggaaaaatatgatgtcagcaccaccggaacggggggcggcggtggcgaatatccattacaggatggctttggctggaccaatggcgtgacgctgaaaatgctggatttgatctgcccgaaagagcaaccgtgtgacaatgttccggcgacgcgtccgaccgttaagtcagcaacgacgcaaccctcaaccaaagaggcacaacccacaccttaa

SEQ ID NO: 135 - protein, 565 aa, Escherichia coli
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTP

SEQ ID NO: 136 - DNA, 1738 bp, Artificial Sequence
  PCR product
  misc_feature (9)..(14): AflII restriction site
  misc_feature (1727)..(1732): XbaI restriction site
cgcaagttcttaagccaaaggagaatgattgatgaaatcccccgcaccttctcgcccgcaaaaaatggcgttaattccagcctgtatctttttgtgtttcgctgcgctatcggtgcaggcagaagaaacaccggtaacaccacagccgcctgatattttattagggccgctgtttaatgatgtgcaaaacgccaaactttttccggaccaaaaaacctttgccgatgccgtgccgaacagcgatccgctgatgatccttgctgattatcggatgcagcaaaaccagagcggatttgatctgcgccatttcgttaacgtcaatttcaccctgccgaaagaaggcgagaaatatgttccgccagaggggcagtcactgcgcgaacatattgacggactttggccggtattaacgcgttctaccgaaaacaccgaaaaatgggattctctgttaccgctgccggaaccttatgtcgtgccgggcggacgctttcgcgaggtatattactgggacagttacttcaccatgttaggacttgccgaaagcggtcactgggataaagtcgcggatatggtggccaattttgctcatgaaatagacacttacggtcatattcccaacggcaaccgcagttactatttaagccgctcgcaaccgcccttctttgccctgatggtagagttactggcgcagcatgaaggcgatgccgcgttgaagcaatacctgccgcaaatgcaaaaagaatatgcttactggatggacggtgttgaaaacctgcaagccggacaacaggaaaaacgcgttgtcaaacttcaggatggtacccttctcaaccgctactgggacgatcgcgatacgccacgaccagagtcatgggtggaagatattgccaccgccaaaagcaatccgaatcgacctgccactgaaatttaccgcgacctgcgctctgccgctgcgtctggctgggatttcagctcgcgctggatggacaacccgcagcagttaaataccttacgcaccaccagcatcgtaccggtcgatctgaacagcctgatgtttaaaatggaaaaaatcctcgcccgcgccagcaaagctgccggagataacgcgatggcaaaccagtacgaaacgctggcaaatgcccgtcaaaaagggatcgaaaaatacctgtggaacgatcaacaaggctggtatgccgattacgacctgaaaagtcataaagtgcgcaatcagttaaccgcggccgccctgttcccgctgtacgtcaatgcggcagcgaaagatcgcgccaacaaaatggcgacggcgacgaaaacacatctgctgcaacccggcggcctgaacaccacgtcggtgaaaagtgggcaacaatgggatgcgccaaatggctgggcaccgttacagtgggtcgcgacagaaggattacaaaactacgggcaaaaagaggtggcgatggacattagctggcacttcctgaccaatgttcagcacacctatgaccgggagaaaaagctggtggaaaaatatgatgtcagcaccaccggaacggggggcggcggtggcgaatatccattacaggatggctttggctggaccaatggcgtgacgctgaaaatgctggatttgatctgcccgaaagagcaaccgtgtgacaatgttccggcgacgcgtccgaccgttaagtcagcaacgacgcaaccctcaaccaaagaggcacaacccacaccttctagagcgctt

SEQ ID NO: 137 - protein, 573 aa, Artificial Sequence
  treA with 6-His tag
MKSPAPSRPQKMALIPACIFLCFAALSVQAEETPVTPQPPDILLGPLFNDVQNAKLFPDQKTFADAVPNSDPLMILADYRMQQNQSGFDLRHFVNVNFTLPKEGEKYVPPEGQSLREHIDGLWPVLTRSTENTEKWDSLLPLPEPYVVPGGRFREVYYWDSYFTMLGLAESGHWDKVADMVANFAHEIDTYGHIPNGNRSYYLSRSQPPFFALMVELLAQHEGDAALKQYLPQMQKEYAYWMDGVENLQAGQQEKRVVKLQDGTLLNRYWDDRDTPRPESWVEDIATAKSNPNRPATEIYRDLRSAAASGWDFSSRWMDNPQQLNTLRTTSIVPVDLNSLMFKMEKILARASKAAGDNAMANQYETLANARQKGIEKYLWNDQQGWYADYDLKSHKVRNQLTAAALFPLYVNAAAKDRANKMATATKTHLLQPGGLNTTSVKSGQQWDAPNGWAPLQWVATEGLQNYGQKEVAMDISWHFLTNVQHTYDREKKLVEKYDVSTTGTGGGGGEYPLQDGFGWTNGVTLKMLDLICPKEQPCDNVPATRPTVKSATTQPSTKEAQPTPSRHHHHHH

SEQ ID NO: 138 - DNA, 1269 bp, Artificial Sequence
  sequence of partially deleted Synechococcus upp
gagctcggtacccggggatcccacggcagcattacggctcagaccttggtcatgccctcgacaacagatctctacttcaccccagaggattgtgaggccgaagcgcagttgattcctaaggcgcactattgcccaattccctcgatctggggtcaccgcgcgggcaaccccagccaaaatccgcaggatgaaagcttcattcggcaggccgttcaggctttgctcaacgctgaagcctagcgaattcagtcagcagatcaaggagtaccaaacaggcgatcgccagcatcccccagccccggcacgataaagcctttgtcgttcagctgctcatcaatgatggcgctgtaaatcgtcaacgccgggtaggcttgactgagtttttgtagcgctggcggggcagccacaattgaaagcacccgcacttgctcagcagagacaccgcgatcgcgcagcaaatcaagggtatagagcagcgagccacctgtcgccagcatcgggtcgagaaccagaacgcgactgttcacttcaagttgctctggcaggtgattgaggtagcagcgcggttcaagactgacttcatcccgctcgcgcagaatcggcacgatcgccaagggttgcgaaaaatcgacgaactccgctggggtttctgcaagaggagtttgcaccgccgctggaatcgttggtagccattcccgcacagcctcataggcgagccagcggcccagctctgcgatcgcggtgcgaaacagaggcgtcggcgtctggcgatcgcgggcaatgcccagccagtgccgaattaagggatggggcggcacgaagatacgcagttgaggagccatgccaatcagcagaagacagctcctgattttaacgttcagaccccaggggaagcggaacggtgcaggaaggcaagcgcttctgcttcgggcagtggtgggccatagaagaacccttgcacagcatcacaaccaatcgcttctaagaaggcggcttgctcgaggcgttctacgccttctgcgatcgtgcgaagtttcaagaccttggccattgcaacaatcgcctgcacgatcgcttgatcgtcatggtcgtgcggcagatcgcgaataaagctgcgatcaattttgagagcattgatgggcaaacgcttgaggtaaccaaggctggaataacccgtcccaaaatcatctaaagcgacttgaaatcccatcgatcgggcttcctggagccattgcagtgggatcctctagagtcgacctgcaggcatgc

SEQ ID NO: 139 - DNA, 2686 bp, Artificial Sequence
  pUC19
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcctgcaggtcgactctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 140 - DNA, 1470 bp, Artificial Sequence; identical to SEQ ID NO: 70
  sll0626 (proposed invertase, aka lim17)

SEQ ID NO: 141 - protein, 489 aa, Artificial Sequence; identical to SEQ ID NO: 71
  polypeptide sll0626 (proposed invertase, aka lim17)

SEQ ID NO: 142 - DNA, 35 bp, Artificial Sequence
  Sspinvdel-F
ggaagatctagacacctatgtccagctcatccatg

SEQ ID NO: 143 - DNA, 56 bp, Artificial Sequence
  Sspinvdel-R
caaacggcgcaaaagcacctgcaggcggtcgaccatggctttttcgtagagcaaac

SEQ ID NO: 144 - DNA, 650 bp, Artificial Sequence
  Ssp6803 Invertase Deletion PCR 1
ggaagatctagacacctatgtccagctcatccatgcccccttggaaccctgcgaactggccttggacaatggacagtggtacgatcgccagaagatccgtcaccagttgcccgctagcaaaaccattgattgcctgttagtagatggaccgcccgcctaccgagaagacattcaatattcccggtttcctgcagtgccttttttccaaccgcaattggcaccccacagcaccatcattttggatgacattaaccgtaggggagaacaggaaattttagcccgttggcaaacattgctcaatgttagttttgatagctccattggcaatgtggcgatcgcccatctgtcggcctagggtaaattttaaaaatcccctgatccaccagtttcagggaaagccgggtaaaaatctgccagtgttgggatattggatattgagggaacgagctagaaccctactatctgtcagcctagcaaaccaaatgctttacatcgtcagactagttcaggaaaattaagtttgacccatagattaatcctaatcttttgctatgaaatccccccaggctcaacaaatcctagaccaggcccgccgtttgctctacgaaaaagccatggtcgaccgcctgcaggtgcttttgcgccgtttg

SEQ ID NO: 145 - DNA, 38 bp, Artificial Sequence
  Sspinvdel-R2
ccgggtgcatgccagtttagcaggaggagccaatcgtc

SEQ ID NO: 146 - DNA, 1427 bp, Artificial Sequence
  Ssp6803 Invertase Deletion PCR 2
ggaagatctagacacctatgtccagctcatccatgcccccttggaaccctgcgaactggccttggacaatggacagtggtacgatcgccagaagatccgtcaccagttgcccgctagcaaaaccattgattgcctgttagtagatggaccgcccgcctaccgagaagacattcaatattcccggtttcctgcagtgccttttttccaaccgcaattggcaccccacagcaccatcattttggatgacattaaccgtaggggagaacaggaaattttagcccgttggcaaacattgctcaatgttagttttgatagctccattggcaatgtggcgatcgcccatctgtcggcctagggtaaattttaaaaatcccctgatccaccagtttcagggaaagccgggtaaaaatctgccagtgttgggatattggatattgagggaacgagctagaaccctactatctgtcagcctagcaaaccaaatgctttacatcgtcagactagttcaggaaaattaagtttgacccatagattaatcctaatcttttgctatgaaatccccccaggctcaacaaatcctagaccaggcccgccgtttgctctacgaaaaagccatggtcgaccgcctgcaggtgcttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccatttattttttgcccaattcctgggaacggcgataggccgcccgcactgcttcgatgatggcggaacgaaaacccatcttctccaataccgctaccccagcaatggtggtgccccccggactggtaactttatctttaatctgggcagggtgctcctccgtttccttgattaactccgctgtgcccaacactgtttgcaaagccaatttttgggcgatcgccctgggtaatccggccaaaacaccaccatcggccagggcttcgatcatcaaagctacgtaggccggtcccgaaccggaaacccccgtcaccgcatccattaaattttccggcacctccaccacattgcccaccgccgaaaagatggccttagccttagccaactgatccggctccaccattttattcgcggcgatcgccgtcataccggccccaacggtggcgggggtattgggcatggcccggatgatggcatggtcgggaaaacccttttgaattctttgcagagaaaccccggccaaaatggaaattaccaggggacgattggctcctcctgctaaactggcatgcacccgg

SEQ ID NO: 147 - DNA, 4077 bp, Artificial Sequence
  pLyb38
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgccagtttagcaggaggagccaatcgtcccctggtaatttccattttggccggggtttctctgcaaagaattcaaaagggttttcccgaccatgccatcatccgggccatgcccaatacccccgccaccgttggggccggtatgacggcgatcgccgcgaataaaatggtggagccggatcagttggctaaggctaaggccatcttttcggcggtgggcaatgtggtggaggtgccggaaaatttaatggatgcggtgacgggggtttccggttcgggaccggcctacgtagctttgatgatcgaagccctggccgatggtggtgttttggccggattacccagggcgatcgcccaaaaattggctttgcaaacagtgttgggcacagcggagttaatcaaggaaacggaggagcaccctgcccagattaaagataaagttaccagtccggggggcaccaccattgctggggtagcggtattggagaagatgggttttcgttccgccatcatcgaagcagtgcgggcggcctatcgccgttcccaggaattgggcaaaaaataaatggacaacggaatttaatgcagcgcttgatgcaaacttttcaaactaggcaaatcgaacatcaaagcatcgtcggggttaacttctgtgaaatggtgtactagcaataggcccacaatggtccaggtttggtaggaacgggattgttgcccgacccaaaagcccgtggggccatcaaaatattcagcccatttatgcttgggcaaacggcgcaaaagcacctgcaggcggtcgaccatggctttttcgtagagcaaacggcgggcctggtctaggatttgttgagcctggggggatttcatagcaaaagattaggattaatctatgggtcaaacttaattttcctgaactagtctgacgatgtaaagcatttggtttgctaggctgacagatagtagggttctagctcgttccctcaatatccaatatcccaacactggcagatttttacccggctttccctgaaactggtggatcaggggatttttaaaatttaccctaggccgacagatgggcgatcgccacattgccaatggagctatcaaaactaacattgagcaatgtttgccaacgggctaaaatttcctgttctcccctacggttaatgtcatccaaaatgatggtgctgtggggtgccaattgcggttggaaaaaaggcactgcaggaaaccgggaatattgaatgtcttctcggtaggcgggcggtccatctactaacaggcaatcaatggttttgctagcgggcaactggtgacggatcttctggcgatcgtaccactgtccattgtccaaggccagttcgcagggttccaagggggcatggatgagctggacataggtgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 148 - DNA, 27 bp, Artificial Sequence
  specSalI-F
ctatgcgtcgaccatccaagcagcaag

SEQ ID NO: 149 - DNA, 30 bp, Artificial Sequence
  specSbfI-R
tgtgagcctgcaggtgcttagtgcatctaa

SEQ ID NO: 150 - DNA, 4252 bp, Artificial Sequence
  pBSL175
gagttccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcggcgcaaagtgcgtcgggtgatgctgccaacttactgatttagtgtatgatggtgtttttgaggtgctccagtggcttctgtttctatcagctgtccctcctgttcagctactgacggggtggtgcgtaacggcaaaagcaccgccggacatcacgcgcgtaatacgactcactatagggcgaattgggtaccgggccccccctcgaggtcgacggtatcgataagcttgatatcgaattcctgcagcccgggggatccactagttctagagcggccgccaccgcggtggagctcgaattgacgcgtcgatccggtgattgattgagcaagctagctttatgcttgtaaaccgttttgtgaaaaaatttttaaaataaaaaaggggacctctagggtccccaattaattagtaatataatctattaaaggtcattcaaaaggtcatccaccggatcagcttagtaaagccctcgctagattttaatgcggatgttgcgattacttcgccaactattgcgataacaagaaaaagccagcctttcatgatatatctcccaatttgtgtagggcttattatgcacgcttaaaaataataaaagcagacttgacctgatagtttggctgtgagcaattatgtgcttagtgcatctaacgcttgagttaagccgcgccgcgaagcggcgtcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactttgttttagggcgactgccctgctgcgtaacatcgttgctgctccataacatcaaacatcgacccacggcgtaacgcgcttgctgcttggatgcccgaggcatagactgtaccccaaaaaaacagtcataacaagccatgaaaaccgccactgcgccgttaccaccgctgcgttcggtcaaggttctggaccagttgcgtgagcgcatacgctacttgcattacagcttacgaaccgaacaggcttatgtccactgggttcgtgccttcatccgtttccacggtgtgcgtcacccggcaaccttgggcagcagcgaagtcgaggcatttctgtcctggctggcgaacgagcgcaaggtttcggtctccacgcatcgtcaggcattggcggccttgctgttcttctacggcaaggtgctgtgcacggatctgccctggcttcaggagatcggaagacctcggccgtcgcggcgcttgccggtggtgctgaccccggatgaagtggttcgcatcctcggttttctggaaggcgagcatcgtttgttcgcccagcttctgtatggaacgggcatgcggatcagtgagggtttgcaactgcgggtcaaggatctggatttcgatcacggcacgatcatcgtgcgggagggcaagggctccaaggatcgggccttgatgttacccgagagcttggcacccagcctgcgcgagcaggggaattgatccggtggatgaccttttgaatgacctttaatagattatattactaattaattggggaccctagaggtccccttttttattttaaaaattttttcacaaaacggtttacaagcataaagctagcttgctcaatcaatcaccggatcgacgcgtcctcggtaccgggccccccctcgaggtcgacggtatcgataagcttgatatcgaattcctgcagcccgggggatccactagttctagagcggccgccaccgcggtggagctccagcttttgttccctttagttagcggagtgtatatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttcccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaaggctaaactgaaaggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttctaggcaccaataactgccttaaaaaaattacgccccgccctgccactcatcgcagtactgttgtaattcattaagcattctgccgacatggaagccatcacagacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacg

SEQ ID NO: 151 - DNA, 993 bp, Artificial Sequence
  pBSL175 Spec PCR
ctatgcgtcgaccatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactaagcacctgcaggctcaca

SEQ ID NO: 152 - DNA, 5042 bp, Artificial Sequence
  pLyb58
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgccagtttagcaggaggagccaatcgtcccctggtaatttccattttggccggggtttctctgcaaagaattcaaaagggttttcccgaccatgccatcatccgggccatgcccaatacccccgccaccgttggggccggtatgacggcgatcgccgcgaataaaatggtggagccggatcagttggctaaggctaaggccatcttttcggcggtgggcaatgtggtggaggtgccggaaaatttaatggatgcggtgacgggggtttccggttcgggaccggcctacgtagctttgatgatcgaagccctggccgatggtggtgttttggccggattacccagggcgatcgcccaaaaattggctttgcaaacagtgttgggcacagcggagttaatcaaggaaacggaggagcaccctgcccagattaaagataaagttaccagtccggggggcaccaccattgctggggtagcggtattggagaagatgggttttcgttccgccatcatcgaagcagtgcgggcggcctatcgccgttcccaggaattgggcaaaaaataaatggacaacggaatttaatgcagcgcttgatgcaaacttttcaaactaggcaaatcgaacatcaaagcatcgtcggggttaacttctgtgaaatggtgtactagcaataggcccacaatggtccaggtttggtaggaacgggattgttgcccgacccaaaagcccgtggggccatcaaaatattcagcccatttatgcttgggcaaacggcgcaaaagcacctgcaggtgcttagtgcatctaacgcttgagttaagccgcgccgcgaagcggcgtcggcttgaacgaattgttagacattatttgccgactaccttggtgatctcgcctttcacgtagtggacaaattcttccaactgatctgcgcgcgaggccaagcgatcttcttcttgtccaagataagcctgtctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactttgttttagggcgactgccctgctgcgtaacatcgttgctgctccataacatcaaacatcgacccacggcgtaacgcgcttgctgcttggatggtcgaccatggctttttcgtagagcaaacggcgggcctggtctaggatttgttgagcctggggggatttcatagcaaaagattaggattaatctatgggtcaaacttaattttcctgaactagtctgacgatgtaaagcatttggtttgctaggctgacagatagtagggttctagctcgttccctcaatatccaatatcccaacactggcagatttttacccggctttccctgaaactggtggatcaggggatttttaaaatttaccctaggccgacagatgggcgatcgccacattgccaatggagctatcaaaactaacattgagcaatgtttgccaacgggctaaaatttcctgttctcccctacggttaatgtcatccaaaatgatggtgctgtggggtgccaattgcggttggaaaaaaggcactgcaggaaaccgggaatattgaatgtcttctcggtaggcgggcggtccatctactaacaggcaatcaatggttttgctagcgggcaactggtgacggatcttctggcgatcgtaccactgtccattgtccaaggccagttcgcagggttccaagggggcatggatgagctggacataggtgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 153 - DNA, 28 bp, Artificial Sequence
  Sspinvdelscreen-F
cgtaaacatctatccattgtggaatgtg

SEQ ID NO: 154 - DNA, 27 bp, Artificial Sequence
  Sspinvdelscreen-R
gctaatgtttctgaagtgctgctgttg

SEQ ID NO: 155 - DNA, 2808 bp, Artificial Sequence
  Ssp6803 Invertase KO PCR Screen - Wild type
cgtaaacatctatccattgtggaatgtggtggtggagtatctacgttgtacattgcccgtttatttcgtcgcaatggtttgcagggccgactccactgtatcgaaaataatttggattggttaaattttttgcatgatgcattggcgagggaagagttgaccacctatgtccagctcatccatgcccccttggaaccctgcgaactggccttggacaatggacagtggtacgatcgccagaagatccgtcaccagttgcccgctagcaaaaccattgattgcctgttagtagatggaccgcccgcctaccgagaagacattcaatattcccggtttcctgcagtgccttttttccaaccgcaattggcaccccacagcaccatcattttggatgacattaaccgtaggggagaacaggaaattttagcccgttggcaaacattgctcaatgttagttttgatagctccattggcaatgtggcgatcgcccatctgtcggcctagggtaaattttaaaaatcccctgatccaccagtttcagggaaagccgggtaaaaatctgccagtgttgggatattggatattgagggaacgagctagaaccctactatctgtcagcctagcaaaccaaatgctttacatcgtcagactagttcaggaaaattaagtttgacccatagattaatcctaatcttttgctatgaaatccccccaggctcaacaaatcctagaccaggcccgccgtttgctctacgaaaaagccatggtcaaaatcaatgggcaatacgtggggacggtggcggccattccccaatcggatcaccatgatttgaactatacggaagttttcattcgggacaatgtgccggtgatgatcttcttgttactgcaaaatgaaacggaaattgtccaaaactttttggaaatttgcctcaccctccaaagtaagggctttcccacctacggcatttttcccactagttttgtggaaacggaaaaccatgaactcaaggcagactatggccaacgggcgatcggtcgagtttgctcggtggatgcgtccctctggtggcctattttggcctattactacgtgcaaagaaccggcaatgaagcctgggctagacaaacccatgtgcaattggggctacaaaagtttttaaacctcattctccatccagtctttcgggatgcacccactttgtttgtgcccgacggggcctttatgattgaccgccccatggatgtgtggggagcgccgttggaaatccaaaccctgctctacggagccctgaaaagtgcggcggggttactgttaatcgacctcaaggcgaagggttattgcagcaataaagaccatccttttgacagcttcacgatggagcagagtcatcaatttaacctgagtgtggattggctcaaaaaactccgcacctatctgctcaagcattattggattaattgcaatattgtccaagctctccgccgccgtcccacggaacagtacggtgaagaagccagcaacgaacataatgtccacacagaaaccattcccaactggctccaggattggctcggcgatcggggaggctatttaatcggcaatatccgcacgggtcgccccgattttcgctttttctccctgggtaattgcttgggggcaattttcgatgtcactagcttggcccagcaacgttcctttttccgtttggtattaaataatcagcgggagttatgtgcccaaatgcccctgaggatttgccatccccccctcaaagatgacgattggcgcagtaaaaccggctttgaccgcaaaaatttaccctggtgctaccacaacgccggccattggccctgtttattttggtttctggtggtggcggtgctccgccatagctgccattccaactacggcacggtggagtatgcggaaatggggaacctaattcgcaataactatgaggtgcttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccatttattttttgcccaattcctgggaacggcgataggccgcccgcactgcttcgatgatggcggaacgaaaacccatcttctccaataccgctaccccagcaatggtggtgccccccggactggtaactttatctttaatctgggcagggtgctcctccgtttccttgattaactccgctgtgcccaacactgtttgcaaagccaatttttgggcgatcgccctgggtaatccggccaaaacaccaccatcggccagggcttcgatcatcaaagctacgtaggccggtcccgaaccggaaacccccgtcaccgcatccattaaattttccggcacctccaccacattgcccaccgccgaaaagatggccttagccttagccaactgatccggctccaccattttattcgcggcgatcgccgtcataccggccccaacggtggcgggggtattgggcatggcccggatgatggcatggtcgggaaaacccttttgaattctttgcagagaaaccccggccaaaatggaaattaccaggggacgattggctcctcctgctaaactggctagcacccggtctagcacctggggtttgacggccaacagcagcacttcagaaacattagc

SEQ ID NO: 156 - DNA, 2591 bp, Artificial Sequence
  Ssp6803 Invertase KO PCR Screen - Spec
cgtaaacatctatccattgtggaatgtggtggtggagtatctacgttgtacattgcccgtttatttcgtcgcaatggtttgcagggccgactccactgtatcgaaaataatttggattggttaaattttttgcatgatgcattggcgagggaagatctagacacctatgtccagctcatccatgcccccttggaaccctgcgaactggccttggacaatggacagtggtacgatcgccagaagatccgtcaccagttgcccgctagcaaaaccattgattgcctgttagtagatggaccgcccgcctaccgagaagacattcaatattcccggtttcctgcagtgccttttttccaaccgcaattggcaccccacagcaccatcattttggatgacattaaccgtaggggagaacaggaaattttagcccgttggcaaacattgctcaatgttagttttgatagctccattggcaatgtggcgatcgcccatctgtcggcctagggtaaattttaaaaatcccctgatccaccagtttcagggaaagccgggtaaaaatctgccagtgttgggatattggatattgagggaacgagctagaaccctactatctgtcagcctagcaaaccaaatgctttacatcgtcagactagttcaggaaaattaagtttgacccatagattaatcctaatcttttgctatgaaatccccccaggctcaacaaatcctagaccaggcccgccgtttgctctacgaaaaagccatggtcgaccatccaagcagcaagcgcgttacgccgtgggtcgatgtttgatgttatggagcagcaacgatgttacgcagcagggcagtcgccctaaaacaaagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataatgtctaacaattcgttcaagccgacgccgcttcgcggcgcggcttaactcaagcgttagatgcactaagcacctgcaggtgcttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccatttattttttgcccaattcctgggaacggcgataggccgcccgcactgcttcgatgatggcggaacgaaaacccatcttctccaataccgctaccccagcaatggtggtgccccccggactggtaactttatctttaatctgggcagggtgctcctccgtttccttgattaactccgctgtgcccaacactgtttgcaaagccaatttttgggcgatcgccctgggtaatccggccaaaacaccaccatcggccagggcttcgatcatcaaagctacgtaggccggtcccgaaccggaaacccccgtcaccgcatccattaaattttccggcacctccaccacattgcccaccgccgaaaagatggccttagccttagccaactgatccggctccaccattttattcgcggcgatcgccgtcataccggccccaacggtggcgggggtattgggcatggcccggatgatggcatggtcgggaaaacccttttgaattctttgcagagaaaccccggccaaaatggaaattaccaggggacgattggctcctcctgctaaactggcatgcacccggtctagcacctggggtttgacggccaacagcagcacttcagaaacattagc

SEQ ID NO: 157 - DNA, 17761 bp, Artificial Sequence
  Predicted Ssp6803 Exopolysaccharide Locus
caatttgcttcttgtttttttgtaccataaaggggtgtcctccttttgattggattttactccccttacacaaaattcagatcactccctgtatagcgacaacagcttaatgcttacaggataaggctttaagggtcatcttgcactattctactcttatctaggttcgacccctacctcaatttattgtgcccgtagtacctaaatttgatctcttttgaaccacgccgaattttggcttttcaccgttgttttaaaggtggtacagtctaggggaatgcctagccaagagcctaatacttgcaagtcttgatcaaagatttttttgagatatgctaaccgttcgttgctaagttgaggacgttttttcatactccagaggcttcttatccaggttcgtaaagatttaggaattagccagcggcgtagctgctttaatcccggtgcttcgactaaaaagtctcgccagcctgagatgcgtatgcgatcgctggatacattttgcggatttaattcttgccaaatgggagttccttgatagccaataaagttacaaacccgttctaactctgcctgggaatgggctaacatccgttcaaaaaagacaggtaacacccgctcacgtccaaactgctcaaagtagggttgtaattgcttgctataaagactgtattcgatcatctctgggaactgatcgatcgccgtgttaatgtccgtatttaccacccgttgggtccattcatggatatattgtgacaccaggcgatcgatgggatgacgcatcacataaataaatttggtctggggaaatgcctctgctaaacgttttacggtgtcagggtaggtgggcaatttcgtgtaatgggtgctggactcaccacagagatcctggggctgggccccggcaaaaagggactggtagtagtccatcccctttgcgaactcctcatcattgctgaaaaaattgggttccttcagcgaagtcataaaaatccccggttgcagagccagttgttcgtggagggtactggtggcacatttcatgccgccgataatgataaaatcggggccttttggatgatctgtagttggggagcagtccgtcatagtgctgtgaacattgggttaaattcctgatagttttcagtatgcttccccaccgcttttgtcgatgtttacgaaatgtttaactttggaaattctactccggacggtagggctttaacggttgtcgccattgaaaccaaatatcttgccattggcgatcgcaggtgtggggttctttctggcccagaatttcccgtagggcggcaatgccccatccccccaaccaacctaaattagccagggctaaacctagggggccataaaatttggcaaagtagcgcgatcgggacgcatatagatagggccggggacgtttacggctggccacatcggatttcactgaaccactacccccccgtaggtgtaccacactggcctggggaatatagcgaattttccaggcagcttgacgggcgcggcgacaataatcaatatcgtcgtagtacataaaataaccgtcatccattaagccaatttgttcaaccaccgatcgccggatgagaacacaggcaaaacttgtccactgcggttcaaaggactgttctgtgacggggatgggcacatcaaagggttgcaagagtttagtaattacactggtacgggccccatcaatcatttcactcaacggtgaatgatcccgaaaacaactaatttggggagtgccatcgggccattccaagcggggactgaacagtcccgcctctggatactgttctagggctactaataaggtttgaattgcccctggccgcacaatggtatcgctattgaggagtagataattctccgctcgaattgcctggattcccaaattattgcccgctgaaaaaccaccattaacatccgaaggcaacagccttacccaatcttgccaattattgttggcgatcgccttttcaatctcttccaccgagtcatcccccgaggcattatcaactacaattacttgctgggtttgggggtcaatttgggatactaatgatgccaaacaatccactacaagctggggggtacggtaattgagaataacaacggcaagctgatacaaatcccagctattgtttgaagcaattatggccataatcttgcaaatactcttagcaactagagggaaaaaagaacttcctagacagctactttttggtaaatattcttagctttgcgggccagattgacaatattggtggcggcgggccagcgatcaaaccattggcgaggggcaatactactacaggaagcccgttgaaatcctaatggaattgaggcgactaaggttttgatctggggattttgttggcgaaaggtggaataagctccatccacatgcatggggccgccatcgggatgaccaccgggacgttctagcaatgtttctaaaaagtcgatcaactggtcaaaaatacggctatggatggcgagaaaatgggcttgaataattggctcatcatagagatgcaaaagggagtttgtgttagctgaaacattatgaccgaagtaaacaaagtcccaggaagtcgtttgtaactcttgcagtaattgggtttgattttgaactaagtcttttgtaaatgtggcatcatcttccaataggagaacctgttccaagttttgggctttggccactttcaaaactcccaaatgacttagaaaacaccccctggcccccaggctcggaaaatttccttggtctgatggctttaccgctgtaaaaaatgcagcatttttgggcaaaccaagaattttaaaccgctgaaactcttggatcatttcccgacggcgatcacctcgttcggctaggttaataatgtatgtgccatcaaaatagttgaagaaagcggaagacatggaataccttttaataagttgcttagaatctgtttgtaaagtcggattctgccccctaaatcccccaatactgggggactttgatttagtttccccccaaacttgggggaccaggggggcttttcaaacacgctcttagggcggggaaaaagtaatgaaattgcagtaagagtaccgaaatctatttgatatattccaagtcaatttggttgattttcagttgtattctgtcccgccacgcccgaagtggtaaacgactggtaatgtaatttaaagtaaacaagactgccccgtaacgctgtaaacgaaagtttgcccgggcccaccaatcctgcaatttaagagattttatttgactacttgtaagctggatcgtgggcagtccactggcttcatagccgcgttgcaacaacaaatccccaactcgggattccaccagttgaatttcccgatcgcctaatttgcgtcgccattgattgagaaaactactatcgggttggtcataggttgtgtcttggttgtactgcaacatcgccgggtcgtaggcgacccctaaaaaattggccagttgggtcaatacagtttggggctcacgaattaggttttcgtaactgatctcaacgtagttattaaccggtagagtttgcttcaacgcctcccaatcttgctctgcttccagccagcgttgggaaccagtccacacattacccgcccagcccataccgatgcaggagcgggccacatcccggggatcccgcacaatatgaataaaacgggcattgggccaaatggccaacaggcgatcgaagtgtcggtgtaccgttgcccccaccactggcttctgttcctgagcttgtttttgctgtaaaaagctttgcaccaattccccataggtcaagttaggggaaacctcaaacccagtagcctgaaaaatacgatgggtctttaaccaatcctgatagtcagatactttgggaaattgagcattatcacttacctgatcgatgacatattcaaactcattacaccaggcaatttgcgaatggtgagacagcatcaagcgtagcagagttgtgccagaacgttcggcaccgatgagaaaggtgggggattcgaggaaagaagtgttcatgggggcgtgacggcgatcgtgagatgggcaattgcaacctgttcttagcttgatggatcgctgtctgatttcgtgcctgccctatgtacaactttgcgtctaactttagaccttttgcctgaccctgactttgagcgccccggcttggttttgagtttcccctgctcactagatttctgcttctgtttttttacctgtttaaccgctggcgatcgggactggggctttaaagattccggtggttgtaaacataatcccgctaaaccaccactaatcaggggaaaaatcggattatacatattgttaatcacagaatccaacttaaacagcaccagacaggtggccagggcggcggcgggggcaactttcggatggagccataacttagcgggatagcgaaatgtggcaaaaacggccgggggtaagagcagggctagggttaagttcagcaggccaaaggctccttgaatgccaaaggcaataatccagaggctatcggtcacagacacatcgacaatttcgccgatccagttttcttcatagacccgattgcgtttccagcccgcccaaccaaaccaaaatcgctctcgggctttttccgctaaaatctcctcatttatccagcgaaagcccagggattgaatgcgatcaggattggtatattcacttaaaaaagcgagaattttatccccatggaactgaccggtcacattcatatagaggaaccagccaaggccaaaaattaaaatgagtaggggcaagtttgattttagaaatttagcagtaaagagaataatcaagccatagaaaaaataaccataggcccctgtcgagcggcaccagatcacggtaaacaccaggaccggaatcaatgatttaatttcgtaattccaaattttggtaaaggttttggactgccagagccagatggtaattaatgctactgtcatcatccacatccccaccatcaagccatgttgcataaacccattgggacgatagccaccgtagcgaatggcctgactaatgccggaaggatgggcataatagccataaacaatcaggtgcaaattgggactcatgcgtccttcccagaggcagatgggcacataaattaaacctgctttaataatgccttcagccaattgtttgagataaattaggcgattaaagtacagcttgcccaacatatagggtaagccccaaaccacagtttgagtgatggattcattaacgccgtcataggcccctaaaccattggtaacagaggacataaatggagaaatacaccacaacatcatgggtatatccagccattcaatccgaaattttttcagccgttccaaatcatggatacaaagccccaccacaatgccgtaacaggtggcgaccatgccctgatagtcggggataagcggcaaagcaaagccagtacgttgcggcagaaaaagtaagcctcccaaaaagctgaccatgacagcggtacggggagggtagcgtcgaaagaaatacagaataactggtaaccacagcaggagaaccagttgggcttggggggtcatggatcgtttgctgttgccatggttgcttcctctaaagcctgttcaaataaggtggtggcatcatcccaactgtagcaactggcagtctggtaggccttgtccgacaacgtttgccattgttcaaggggttgagtgcagattttgacaatggctgcggcgatctccgctggatcttcagggggtactaaaatcccacctccctgctctatcagttccggggccgctcccgtgggggtcccaatcacaggggtgcggcaggccatggcttctaaaataggtaaaccaaacccctccaaccgactggtaaacagccaggcatcacagcttgcataaatttcttttaacttctcctgagcaactttgtgatgataggcgatcgcctccggcaaaggtaaattgctggaaacaggttcagaaccaaaggcaatgccctttaaatttggtaatttttcctgagctagttgccaaccctgaatcgccaaatccgttcctttccaagctttagtggagtacataaagccaacggtgggtacagtttgacggccccggggggacgctgagaataactccaaatcaacactattgggcacaagggagacttgggaatccccatattcctctgccatcacctttttcagccactcggcaatgacgattttatacagcggcaaacgataggtggccttaactcgctcgacgggaaaatagggatgtatttcatggtgttggacaaagtaaactttttgccctttgctcggtgaaagtttagctacccactcagcggttccccaccaggtagcaatcaccacatccccatctggtaaatcccgatcgccaacggcacgacaggtttccagcactttatggggtacgtttaacccgtcaaaatgggaggcggacggctgagcaggggtctttttcccccgaagccattggctaattctctgctttattccaggtttaggtagaggctgggaaattataaatacctcatggcctcgtttttgcaggcgatcggcataaatggccaccacccgaatgccccccgctaaaccggcatagggtaaaacaaaggtgattttcatactcctaactccataacgcttcaatcggtaaacccagtcccagactccagcgaattgtgatcaaaagactagcaacccccagtagtaatagagtggagagtaaatcttggcgaaaaccactcaatttttcctgccaaaccccgtaagccactgctagatagtacggcagatcattggccgccaccacaatcaccgcccctaaaaccccaaagctgtgaaaccccaggggaataaaaatcagcatataggcaaatttggcaaagttaccgatcgccactaattgaggcttacctagggcatagaggacaggatcaatagttaaagccagggttggtaaccataaaccggccgctaggatgggtaacatccaggccccagcccgatagcgttcatcgtagagaaaaagaataagccaatcgccaaaactgatcatcacagcaatggcgatcgccagcgcccctagtaataaccagcgttttttaaggattttactgcgtaactcagcccggggtaagtctatttgttgggaaattacgggaaacatgaccttgccattgactcgactcaaaacttgccggggtagttctgccagggtaaaggcgatggtataaacccccagtaaggttaggctgaaaattttccctagaatcaggcgatcggcctgggtggcgagaaaggtcatggctgtggaaacaaaaatccagcggccaaagcgagcaatttcttgtaaagcagtgggatcccaggtaaagcgattgcggggttcagccaccaggtaatgactccaaatcattttcaccagactgagcacaaaattacccatcaccaacgcccaaatggtgggattgaaccaggcccagacaatcatcaccaccagcccaattgactgcacgatgaattcaaaacgggtcagcttgcccagatcaattttgcggttgagggtaaataatgccgtggagttaaaccccgcaatgatggtagaaaaccccaccaagggtagtaaccaaattagttggcgatcgccataaaaacgggaaaccggtagggcaataaggcaacaacagagccatagcccaacaccccgtataacctgaatagtccaagccgtgttgagaaaactaggctcatccccccgtttgttttggataatgctggggccaatgccaatatcagaaaataaattgagaccaatgataaaggtatttaccaacgccatcaggccaaacatttccggcaccaacaaacgagtcagcaccagattacccgccagtctgagcacctgactagaaccatagccaacaaaagtccaaatggtgccacgaatggccagtttattgagggaagccatagttacggcgccgatgcgtaggtgtgaaaatgctgggctaatttttcagcctctttatgaacatcatgatccatctgcaccgcttgctgacccattgcggccatggcggtaagttgttcacaagacatagttaaaacagactgcattgcttctactaaatcaggaatggagcctgggggcacaagccagccggaaacccccggtttgaccagttccggtatgccggccacataggtgctgatcaccggacgacccagggcaaaggcttccataattaccaccggtaaaccttcggcgaaactcggcaaaaccatggcccgggaagctaataaatgttgctgcaccatggcactactggcccagccagtaatagtaatgttttcttcgagttgatattgctcaattaattcttcaatgggcgatcgcagttccccatcccccactaaaaccagctttaccgcaataccgttatcccgtaattgtcgcactgcttgtactaaaagcaattgccctttttgttcacacagtcggcctacacagactagttgcggaacctctggtaccggggtgatttcttgttggagataatccgccgccaatgcacaatggactacttgaattttgggccaatctgccaagctacaccagcggtaaagttgacttttgccgtaggaactaatggccaccacaaagcgggcccggctaattttttcgggaatggcgatcgcctccggtcggtcaaattcctccgggccatggacggtaaaactataactaatgtctcctaaactggcacagagcatagcaacggtggtggagttggtgccgaagtgggcatggatatgggtaatacccgccgctttgagccaccgccacagcagacaagcttccaagaaataggcaaaatggcgcagtagtccccggtgcgatcgccgacccacttgtatggttaagccgagggttttcagccatgggggcaggcgggagattgctaaaaaaagaccactccctagtaagggtatcaatccagcccccagcagtgcccgagttcgttgacattcctggcgatcggcttcgtctgctaaatcagtctgggcaatgggtcgaacagaaatacgctctacgacaacaccaagctcttccaaagccagaatttcacgacgaatgaaactatgactaatcttggggtactgattaatcagatatgcaactttcataaattcttgcacgagttttcttttccattgattggacccacctaagtgaattttgacttcctttactgcctccaaggctagttgtgcccggaattggggcgatctcaccattagccccgaatcaattatcctaaaaagtagcagggaggagtccgtgacgttgcaagtccttcaatcaatcccaaaggagtttaacccatcatgccaacagttgaaactgacttggcccaaatcctggaaaggatagacggcaagctagaccgaattgaaaaagacatcagtgacattaaagtttcccaagcagaagttaaaggggaaatcaggacccttgacgaaagactctctggacagataaaagctaccgatgaaaaactatccggacagataaaaaccaccgatgaaaaactctctggacaaataaaaacccttgacgaaagactctctggcgagataagcacccttgatgaaaaggtcactggcattggcaagcgtctggaaaatcaggaatttaccagcagaggcattctgacagctttaatcattgctctcattgcaggagccgctaaattctttggcatcttccctaatccctaaccgtcaatccctcagatggtggcgattacccctaggacaggaatttgaaacttttctaccgttgttaaagcctggtgagtttgggactgggacgtatatttaaggcgaactattagacagactccatcagtacgattcaaaagaaagggggtatctgggacagttaacaatggggcgttatagatgaccaaatcatatttgtgggtcaaggtttggagtgccgggtcgaggcgactcagccagcgctgtaaacgaatgggatggccagcgttcattgtgccaacagggatgattgccaaaccgtcctcatagtggactagattaagtaactgttgcgggtcggtatcgctatttaaaacattgaccagtccctgctccaattcatcagtattattgccatggtgatgaatgtcgggatgttgcaaattggtatctatcaccaaaacagtctgaccagcattgactgcggcccgggcaaattgcatcgtcacagatgcttgaccactttcgttatcgatcgccgtcatggccatggaacgaataccttgctcttgatactgaaaataaaaattggtgtaaatttgctggcccctatcctcccccatggcaacaatcgcctcatttgcttctgtgggcaaaacttcgtcttctaaagcatctttatcatgggcaattcctgaatccagcagcggcaattccccccaaacggagtaacccaagccaaatttaaggtcgctgttgctgtaaaaaatattccgactcctttcccaggcgatcgccagcagcaatcccaaaactaggccgctccccataccagcaatcatttttttcttcggatcaggggggaaagaaatcggcaaaccatcgggcccccggggaatagctggtgcagaaatgattttccaagggacatcctgttgggccgcttccacccgcaacgtttcccgttgattggctaatgtatccagtaaccctttctttaaatcaagctgtcgtgccacctcatcgtattgagccgcaatggtgggaaattgatctaagttaatccgaagacgctcttggttagccaccagaacttgccggcgagttaagcgtttagcaatttcattttgcgtcacaattaactggtccagcatggtaattcggctggtattctgaaacataaaaatattggggttattatcaccttttagggagctagatttgagaatttctttagttctagtttctaaaagagtttgcagattgttccgtttttgaaacaagtcctgcattatgggattttcattggtgaaacgactggattcggcggcaatcatcgtttctacttcttgcaattgctgtaacagattttggcgctctggattttggctcagatcaaggacaaccaatgcttctgatggtgaaagccctaaagttgattctaggtttgattttaatgatcttaattcttccagctcttcatcaattttctggatatcgagttgattagcttgataagcctcgttgagattagtggcctgttgattggggctaattatgttatagcgctgttgtagggtccgctgttgtccttgcaaggcgcggatttgggtttctaaaattggaatttgttcatcaataaagctcacaccagcttgtaaactattttcccgttcctgcagactatattgtaaatattgctcggcagttacctttaaaacagtctccaccaaaacggcatcattgccttcatagattacttcaaggatttttgtatagtcgaagcggctatttccttcttgcacacgcttgacaattaaatttttctgcaaattttgtaacattgctgcttctggaatctgggggagaatattatgaacttcagcggcaatttttgacaacagtaccgtacttttaaggatttttagttgggtgggataatcaaggtttaaaagttcttgactgggtaaatcattgctacgggttaatacagaggcatctgttagcttttctgctgatgtaactggttcaattaagatttcaaagcggcccacataggtggaggggtcctgggtactcagataagaagtaaccactaagccagccccggcaaaagcgacaatgataaaccactttcgcaaaacaaggttgagataaacccgcaccaaatttttcgaagttgctgggggtgagactgcctcaatctctgcttcttctgttgctaaaaattcttctgcttcatcgtgagccatggaatattcgggcgctttgagagatctttatgggagcggagactcgaagctgaacggtgatcttagtggcgatcagcggcacactcagagtatagcaaggaactaaatggcctaattttcttaagttaaacaccggtcaagcacgaagttagacggcgcccagtaatcatagcaatgcggacgttaagaccgagctaatccaacctattctcagtgccatggtggcgatcgccaaacttagtgcttcccaacctgggagggtgaaaaccttgtcagaacatcctttcccctatcctcagcaagttactttacccagttggcagttgaaaaactcaaaaacggcgatcgttgctggcaagtcccctggtcaacgctatatcttgcaaaaaggggatataactgccaccatcaccgcttgcctcaatccgaatgcccccagtaccctcacagagcaacaatttatcagcaataaatatcgccataaccttcatttttttgcctggttagctggacaaaaagatttaacggatagcagttgtttatggaccctcatctccgccccgatcgccccggatgcaactccggatgagattactcaaacctttcaacaattggaaacggcctgggtagagtggtatcaatggtggcaactccactaaactccccaagcaaccacctccatagttaacctccactaaccaccatggaagatttaggaattgtcgttattgggcgcaacgaaggcgatcgcctcaaggactgtctgcgatcggtggtagaagctggcctggttatttatgttgattccggctccaccgataacagtattgaatttgcagaatctctcgatgttgtggttgtccgtcttgatttagcgcaacccttcactgccgcccgggcccgcaatgctggcttggccaaattattagaactacagcgaagtaccaaatatgtacagtttgttgatggtgattgtgaagttattaccaattggttagcaacagcctatcagtttttagaagagaatagggcgatcgccgtggtttgtggtcggcgcagggaacgctacccggagcaatcaatttataatcagctctgcgatctggaatgggatacgcctgtgggtcagacgaaagcctgcggcggagatgccatggtgcgagtgacagcatttcaaacggtagggggatttaacgagggattaattgctggggaagaaccagaactctgtgtacgtttgcgacaacagcagtggcaaatttggcgcttggataccgaaatgacttggcatgatgccaacatgttgcattggcaccagtggtggaaacgccatgttcgtgctgggttcgcctttgccgaaggagcgtggctccatggtcaaccaccagagaagcattgggttaaagaaagccgcagtatttggttctgggcattgatcattccagttgtcagtctgggatctagttgccccactttcggtctgagcttagttttgctgttgggttacccgttgattatctataaaacggcacggtattttcagcaacaaggattatccgcccagttagcctggctctatgccacttcctgtctgctagccaaatttccccagttcattggccaactgcgttttcactggctccgcctcaccaaacaaacagcgacgattgttgaatataaagctcgatcataaagttatacggtgcgtaaacaaaacatagacatgagcttaaacagtcctgctcgaagatgaaagtgtcatcaaaaaaacaccggggctaagcaatgaattccatcacgcttctcaacacaacgatccataactactccatggttgagttacttgaagatctcaataagcgtggtggatttgtggttacgccaaatgtggatcacatggttaagttgcaggaagatgctgagctgcaagaggtttaccaagtggcagattaccgagtttgtgatagcaaaatcattgaatacattctcaaactgttaggtacaccgattaaagagaaaatctctggttctgacttgtttcctgctttttatgaatacaacaaagacaatactgataccaaaatctttctgctcggtgctaaagaaggggtagccgatcgcgctcgccaaaaaatcaatgaaaaagtaggccgagagatgattgttgattcctattcccctagcttcggctttgagcaaaatcctgaagaatgtgcctacattctagagcgcatcaaacaatccggtgccaccgtgttagcagtgggtcttggggctcccaagcaagaaaagtggattgctaaatatcgtcatcaactgcccaatatcaaaatttttctggcgatcggcgctaccatcgacttcgaagcgggtgaaaaagcccgttccccccaatggatgagcaaagtcgggttggagtggctccaccgcttagcctctgaacctcagcggttatggaagcgttacttggtggaaagcctaccgttctttgccttggtgttacagtacaaactgcaaacccttctgtctgagcctgcttatcctcagttatctactgctgattctcggaccgtttaggtgtttcggggttgcctagccaaagaatggggaaattttgagggaagatcgccctgtcctatagcgattagagtgttggataacttaaacgatctaacattgccacaggtctcgtttcattctcctctcagttctcagcttgccgctatgctcatcaccgttttcatttcggcgatcgccgttgttgtccttgtgcccagtgccattctgttgttggagtgtggtgcagcttgtttagctccctcggaaagaactcaggcggttccaggtaatcaagccagaacgccagcgggattgcgggttgcggtgttggttcctgcccacaacgaagcccaggtcattgcggaaacattgcaaagtattcagccccagcttactcccgcagataccttactggtggtagcggacaattgcaccgataccacggctattattgccgaaagagaaggggctacagtgattgaaagaattgatcaagaaaagcggggcaaaggctatgcgttggattatggggtgcagtacctagcccaacacagggaaccggacattgttattcttatggatgcagattgttacgttcatccaaactgtattgaacaactaaccaccatggcggcgcaacgacagcgaccgattcaaagctgttatgtcatggctacacccgcagaacccagcattaaggatcgactttccgcctttgcttttttggtaaaaaattgggtacggcccctcggattaagtcaactgggtgccccctgcctcctcacaggcactggcatggctttcccctggacgattctcaagaatgcccccctggccagcgataatattgtcgaagatatgcagttgggactggatttggcgatcgctggttatgcccccctgttttgtcccatggccctggttacggggttacttcctaaagcccaggacaccgctatacaacaaagaacccgctgggaacacggacatttaaaaacttttattagccaagctcctcggttgctgaaagccgctattgggcaagttcgtctggatctcctggctctggtgggagaattgagcattccgcccatctctttcctagttttactctggttaacttacgctttcgtcagtttactagcaagtttggcaagtgacagttatctgccccttttattagcgaccatcgctggggccatgttgggaatggcaattttgctggcttggatgaaggcagcccaggaaatactgccctttaccaccctgttaatgacccctctatacctattgtggaaaattcctctttatttcaactttttcaggaaaccccaaaccaactggaataaaacaaaacgggacacggcgatcggaaaacgggatacttaaaataaacccagttggaactaggtttatgttaaagaaatacagaatggctaaaatggcccaacgggcactgtcttcttaaggagtgaggtgatgaaaacctctacacgtcaggatttctgaaatttgaacagggcggtcaataaatcccatagccatggccggagtggtatttttcctcagacttccatagggacgagttcaattgtgaagcaacctctggacattaagggctctctgcaacccctccagttccttggcatagtggttttgtcgccgttgtagggcactattcaatgcttctaaatgattggtatgtactgctgacgatgggctaattggcataaattgtccaaccttccgactgttcgggggggggaagcttctcacccactcgggtgtagagttcatcttcttattctcagtatcccaagacggcatttgcgttgatatctatgcaattgtctgtttaacgtttctggacctgtacctaaaaccccattacttttctcacggacccctagaatcgaagagatttttggcacgattgcggtgctactttgagacaaacctacctagcaagcgccactacgttttgaaaaaacgacttggatggttttcaaaattagtttgatgtcatagcccaagctccagcgtttctgatagttaagatccatttccacaacttgatcgaagtttaagactgtagagcgaccattaacttgccattctccggttaagccgggtttcacttctaagcgattgctctggtgggagttatactgggcaacttcatccaaagtggggggacgggtgccgactaagctcatctcgccgattaaaacattccagaactgagcaaattcatcgaggctagttttgcggagaaatttgccgactttggtaatgcgggggtcgttggtatttttaaagaaagcaccatcaatttcattctcaacttgatgcttcagggcttcagcgttggttaccatggagcgaaatttccagattttgaattgttgacccttataaccacagcgggtttggctaaacagtaccggaccagggctatctaatttaatggcgatcgccaggggaataaagaggacggaggtaatggtcaaccccaccaatgcaccgacaatgtctaataaccgtttccctttggaaatgacagaaggatgaacctgttgatcaaaagctacatcgacattatcgccaaagacttgattggttgtttcagtaaaggtgaaatattgatcaattcctgctagagtcagcacctgtttcagttgcgggcgtaaactccaccccaataattcaacccctttatcctttgcttgttgtgacaattggcggaggtaaacgatcgccgcactgtccaacacacgggtcttagcaaaatcgaacaccagccgacccacttgcgcctcagcctcaaaccattcagccaattgggactgaataaatgcaacttcctgttgacaaaagctttggggaacttcaatcagttgaatagtgctagccataggtaatcaccaaggagttagagaacaaaggcagtgtttaggtgaactcgtggttgccgtttaaccgcctatatctactgtctctcacccatatttacgtttaggcctaagccaatgtctaacttcttgaaaatgggttccaaaaattctctatcattgtaaa

SEQ ID NO: 158 - DNA, 36 bp, Artificial Sequence
  epsko-F
ttcaagtctagacgttggtagatcagcaatgtcttg

SEQ ID NO: 159 - DNA, 65 bp, Artificial Sequence
  epsko-R
gactgtattcgatcatctctgggacctgcaggaatgtcgactagagtcagcacctgtttcagttg

SEQ ID NO: 160 - DNA, 31 bp, Artificial Sequence
  pSYSM-R2
tttgccgcatgcagttcctccaattgaggac

SEQ ID NO: 161 - DNA, 700 bp, Artificial Sequence
  EPS KO PCR 1
ttcaagtctagacgttggtagatcagcaatgtcttgccagtctaaatccaattgaaaacagatttccataaaaatattgcggtcaaccgggcgaccggtcaaaaacttccacacggaattacgggtggataaacccgcttcgatcgccaaatattcctgggtccagccccggcacaacatcgcctgcttggcttgggcttgcccatctggtgaagctttaagggaacgttttgccatgtttacaatgatagagaatttttggaacccattttcaagaagttagacattggcttaggcctaaacgtaaatatgggtgagagacagtagatataggcggttaaacggcaaccacgagttcacctaaacactgcctttgttctctaactccttggtgattacctatggctagcactattcaactgattgaagttccccaaagcttttgtcaacaggaagttgcatttattcagtcccaattggctgaatggtttgaggctgaggcgcaagtgggtcggctggtgttcgattttgctaagacccgtgtgttggacagtgcggcgatcgtttacctccgccaattgtcacaacaagcaaaggataaaggggttgaattattggggtggagtttacgcccgcaactgaaacaggtgctgactctagtcgacattcctgcaggtcccagagatgatcgaatacagtc

SEQ ID NO: 162 - DNA, 1746 bp, Artificial Sequence
  EPS KO PCR 2
ttcaagtctagacgttggtagatcagcaatgtcttgccagtctaaatccaattgaaaacagatttccataaaaatattgcggtcaaccgggcgaccggtcaaaaacttccacacggaattacgggtggataaacccgcttcgatcgccaaatattcctgggtccagccccggcacaacatcgcctgcttggcttgggcttgcccatctggtgaagctttaagggaacgttttgccatgtttacaatgatagagaatttttggaacccattttcaagaagttagacattggcttaggcctaaacgtaaatatgggtgagagacagtagatataggcggttaaacggcaaccacgagttcacctaaacactgcctttgttctctaactccttggtgattacctatggctagcactattcaactgattgaagttccccaaagcttttgtcaacaggaagttgcatttattcagtcccaattggctgaatggtttgaggctgaggcgcaagtgggtcggctggtgttcgattttgctaagacccgtgtgttggacagtgcggcgatcgtttacctccgccaattgtcacaacaagcaaaggataaaggggttgaattattggggtggagtttacgcccgcaactgaaacaggtgctgactctagtcgacattcctgcaggtcccagagatgatcgaatacagtctttatagcaagcaattacaaccctactttgagcagtttggacgtgagcgggtgttacctgtcttttttgaacggatgttagcccattcccaggcagagttagaacgggtttgtaactttattggctatcaaggaactcccatttggcaagaattaaatccgcaaaatgtatccagcgatcgcatacgcatctcaggctggcgagactttttagtcgaagcaccgggattaaagcagctacgccgctggctaattcctaaatctttacgaacctggataagaagcctctggagtatgaaaaaacgtcctcaacttagcaacgaacggttagcatatctcaaaaaaatctttgatcaagacttgcaagtattaggctcttggctaggcattcccctagactgtaccacctttaaaacaacggtgaaaagccaaaattcggcgtggttcaaaagagatcaaatttaggtactacgggcacaataaattgaggtaggggtcgaacctagataagagtagaatagtgcaagatgacccttaaagccttatcctgtaagcattaagctgttgtcgctatacagggagtgatctgaattttgtgtaaggggagtaaaatccaatcaaaaggaggacacccctttatggtacaaaaaaacaagaagcaaattgtgtggataccttactagacgagttgctggaagagtatcaaaccccggaagaaatactgggagaatcaggactactaaaacaactaaccaaacgcttgatagagcgtgcattggctggggaactgagtcatcacttaaaaaatcaggcagaggaagagaagcgcaatagtcgcaacgggtactcaaagaaaacagtacagtcggagcaaggagaaatggaattggccatcccccgagaccggcagggaaaatttgagccagtgctagtgcccaaaaatgagcgtcgcatcgcgggattagatgagaaaatccttgctttgtatgcgcgtgggatgagtactcgagatatcagtcctcaattggaggaactgcatgcggcaaa

SEQ ID NO: 163 - DNA, 4396 bp, Artificial Sequence
  pLybAL61
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcagttcctccaattgaggactgatatctcgagtactcatcccacgcgcatacaaagcaaggattttctcatctaatcccgcgatgcgacgctcatttttgggcactagcactggctcaaattttccctgccggtctcgggggatggccaattccatttctccttgctccgactgtactgttttctttgagtacccgttgcgactattgcgcttctcttcctctgcctgattttttaagtgatgactcagttccccagccaatgcacgctctatcaagcgtttggttagttgttttagtagtcctgattctcccagtatttcttccggggtttgatactcttccagcaactcgtctagtaaggtatccacacaatttgcttcttgtttttttgtaccataaaggggtgtcctccttttgattggattttactccccttacacaaaattcagatcactccctgtatagcgacaacagcttaatgcttacaggataaggctttaagggtcatcttgcactattctactcttatctaggttcgacccctacctcaatttattgtgcccgtagtacctaaatttgatctcttttgaaccacgccgaattttggcttttcaccgttgttttaaaggtggtacagtctaggggaatgcctagccaagagcctaatacttgcaagtcttgatcaaagatttttttgagatatgctaaccgttcgttgctaagttgaggacgttttttcatactccagaggcttcttatccaggttcgtaaagatttaggaattagccagcggcgtagctgctttaatcccggtgcttcgactaaaaagtctcgccagcctgagatgcgtatgcgatcgctggatacattttgcggatttaattcttgccaaatgggagttccttgatagccaataaagttacaaacccgttctaactctgcctgggaatgggctaacatccgttcaaaaaagacaggtaacacccgctcacgtccaaactgctcaaagtagggttgtaattgcttgctataaagactgtattcgatcatctctgggacctgcaggaatgtcgactagagtcagcacctgtttcagttgcgggcgtaaactccaccccaataattcaacccctttatcctttgcttgttgtgacaattggcggaggtaaacgatcgccgcactgtccaacacacgggtcttagcaaaatcgaacaccagccgacccacttgcgcctcagcctcaaaccattcagccaattgggactgaataaatgcaacttcctgttgacaaaagctttggggaacttcaatcagttgaatagtgctagccataggtaatcaccaaggagttagagaacaaaggcagtgtttaggtgaactcgtggttgccgtttaaccgcctatatctactgtctctcacccatatttacgtttaggcctaagccaatgtctaacttcttgaaaatgggttccaaaaattctctatcattgtaaacatggcaaaacgttcccttaaagcttcaccagatgggcaagcccaagccaagcaggcgatgttgtgccggggctggacccaggaatatttggcgatcgaagcgggtttatccacccgtaattccgtgtggaagtttttgaccggtcgcccggttgaccgcaatatttttatggaaatctgttttcaattggatttagactggcaagacattgctgatctaccaacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 164 - DNA, 3728 bp, Artificial Sequence
  pE194
gatcagtacaagaaagatactgtatttcataaacaggaactgcaagaagttaaggatgagttacagaaggcaaataagcagttacagagtggaatagagcatatgaggtctacgaaaccctttgattatgaaaatgagcgtacaggtttgttctctggacgtgaagagactggtagaaagatattaactgctgatgaatttgaacgcctgcaagaaacaatctcttctgcagaacggattgttgatgattacgaaaatattaagagcacagactattacacagaaaatcaagaattaaaaaaacgtagagagagtttgaaagaagtagtgaatacatggaaagaggggtatcacgaaaaaagtaaagaggttaataaattaaagcgagagaatgatagtttgaatgagcagttgaatgtatcagagaaatttcaagctagtacagtgactttatatcgtgctgcgagggcgaatttccctgggtttgagaaagggtttaataggcttaaagagaaattctttaatgattccaaatttgagcgtgtgggacagtttatggatgttgtacaggataatgtccagaaggtcgatagaaagcgtgagaaacagcgtacagacgatttagagatgtagaggtacttttatgccgagaaaactttttgcgtgtgacagtccttaaaatatacttagagcgtaagcgaaagtagtagcgacagctattaactttcggttgcaaagctctaggatttttaatggacgcagcgcatcacacgcaaaaaggaaattggaataaatgcgaaatttgagatgttaattaaagacctttttgaggtctttttttcttagatttttggggttatttaggggagaaaacataggggggtactacgacctcccccctaggtgtccattgtccattgtccaaacaaataaataaatattgggtttttaatgttaaaaggttgttttttatgttaaagtgaaaaaaacagatgttgggaggtacagtgatggttgtagatagaaaagaagagaaaaaagttgctgttactttaagacttacaacagaagaaaatgagatattaaatagaatcaaagaaaaatataatattagcaaatcagatgcaaccggtattctaataaaaaaatatgcaaaggaggaatacggtgcattttaaacaaaaaaagatagacagcactggcatgctgcctatctatgactaaattttgttaagtgtattagcaccgttattatatcatgagcgaaaatgtaataaaagaaactgaaaacaagaaaaattcaagaggacgtaattggacatttgttttatatccagaatcagcaaaagccgagtggttagagtatttaaaagagttacacattcaatttgtagtgtctccattacatgatagggatactgatacagaaggtaggatgaaaaaagagcattatcatattctagtgatgtatgagggtaataaatcttatgaacagataaaaataattaacagaagaattgaatgcgactattccgcagattgcaggaagtgtgaaaggtcttgtgagatatatgcttcacatggacgatcctaataaatttaaatatcaaaaagaagatatgatagtttatggcggtgtagatgttgatgaattattaaagaaaacaacaacagatagatataaattaattaaagaaatgattgagtttattgatgaacaaggaatcgtagaatttaagagtttaatggattatgcaatgaagtttaaatttgatgattggttcccgcttttatgtgataactcggcgtatgttattcaagaatatataaaatcaaatcggtataaatctgaccgatagattttgaatttaggtgtcacaagacactcttttttcgcaccagcgaaaactggtttaagccgactgcgcaaaagacataatcgattcacaaaaaataggcacacgaaaaacaagttaagggatgcagtttatgcatcccttaacttacttattaaataatttatagctattgaaaagagataagaattgttcaaagctaatattgtttaaatcgtcaattcctgcatgttttaaggaattgttaaattgattttttgtaaatattttcttgtattctttgttaacccatttcataacgaaataattatacttttgtttatctttgtgtgatattcttgatttttttctacttaatctgataagtgagctattcactttaggtttaggatgaaaatattctcttggaaccatacttaatatagaaatatcaacttctgccattaaaagtaatgccaatgagcgttttgtatttaataatcttttagcaaacccgtattccacgattaaataaatctcattagctatactatcaaaaacaattttgcgtattatatccgtacttatgttataaggtatattaccatatattttataggattggtttttaggaaatttaaactgcaatatatccttgtttaaaacttggaaattatcgtgatcaacaagtttattttctgtagttttgcataatttatggtctatttcaatggcagttacgaaattacacctctttactaattcaagggtaaaatggccttttcctgagccgatttcaaagatattatcatgttcatttaatcttatatttgtcattattttatctatattatgttttgaagtaataaagttttgactgtgttttatatttttctcgttcattataaccctctttaatttggttatatgaattttgcttattaacgattcattataaccacttattttttgtttggttgataatgaactgtgctgattacaaaaatactaaaaatgcccatattttttcctccttataaaattagtataattatagcacgagctctgataaatatgaacatgatgagtgatcgttaaatttatactgcaatcggatgcgattattgaataaaagatatgagagatttatctaatttcttttttcttgtaaaaaaagaaagttcttaaaggttttatagttttggtcgtagagcacacggtttaacgacttaattacgaagtaaataagtctagtgtgttagactttatgaaatctatatacgtttatatatatttattatccggaggtgtagcatgtctcattcaattttgagggttgccagagttaaaggatcaagtaatacaaacgggatacaaagacataatcaaagagagaataaaaactataataataaagacataaatcatgaggaaacatataaaaattatgatttgattaacgcacaaaatataaagtataaagataaaattgatgaaacgattgatgagaattattcagggaaacgtaaaattcggtcagatgcaattcgacatgtggacggactggttacaagtgataaagatttctttgatgatttaagcggagaagaaatagaacgattttttaaagatagcttggagtttctagaaaatgaatacggtaaggaaaatatgctgtatgcgactgtccatctggatgaaagagtcccacatatgcactttggttttgtccctttaacagaggacgggagattgtctgcaaaagaacagttaggcaacaagaaagactttactcaattacaagatagatttaatgagtatgtgaatgagaaaggttatgaacttgaaagaggcacgtccaaagaggttacagaacgagaacataaagcgatg

SEQ ID NO: 165 - DNA, 1152 bp, Artificial Sequence
  pE194 MLS PCR
taagtcgtcgacccgtgtgctctacgaccaaaactataaaacctttaagaactttctttttttacaagaaaaaagaaattagataaatctctcatatcttttattcaataatcgcatccgattgcagtataaatttaacgatcactcatcatgttcatatttatcagagctcgtgctataattatactaattttataaggaggaaaaaatatgggcatttttagtatttttgtaatcagcacagttcattatcaaccaaacaaaaaataagtggttataatgaatcgttaataagcaaaattcatataaccaaattaaagagggttataatgaacgagaaaaatataaaacacagtcaaaactttattacttcaaaacataatatagataaaataatgacaaatataagattaaatgaacatgataatatctttgaaatcggctcaggaaaaggccattttacccttgaattagtaaagaggtgtaatttcgtaactgccattgaaatagaccataaattatgcaaaactacagaaaataaacttgttgatcacgataatttccaagttttaaacaaggatatattgcagtttaaatttcctaaaaaccaatcctataaaatatatggtaatataccttataacataagtacggatataatacgcaaaattgtttttgatagtatagctaatgagatttatttaatcgtggaatacgggtttgctaaaagattattaaatacaaaacgctcattggcattacttttaatggcagaagttgatatttctatattaagtatggttccaagagaatattttcatcctaaacctaaagtgaatagctcacttatcagattaagtagaaaaaaatcaagaatatcacacaaagataaacaaaagtataattatttcgttatgaaatgggttaacaaagaatacaagaaaatatttacaaaaaatcaatttaacaattccttaaaacatgcaggaattgacgatttaaacaatattagctttgaacaattcttatctcttttcaatagctataaattatttaataagtaagttaagggatgcataaactgcatcccttaacttgtttttcgtgtgcctattttttgtgaatcgattatgtctttcctgcaggcggctt

SEQ ID NO: 166 - DNA, 5520 bp, Artificial Sequence
  pLybAL62
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgcagttcctccaattgaggactgatatctcgagtactcatcccacgcgcatacaaagcaaggattttctcatctaatcccgcgatgcgacgctcatttttgggcactagcactggctcaaattttccctgccggtctcgggggatggccaattccatttctccttgctccgactgtactgttttctttgagtacccgttgcgactattgcgcttctcttcctctgcctgattttttaagtgatgactcagttccccagccaatgcacgctctatcaagcgtttggttagttgttttagtagtcctgattctcccagtatttcttccggggtttgatactcttccagcaactcgtctagtaaggtatccacacaatttgcttcttgtttttttgtaccataaaggggtgtcctccttttgattggattttactccccttacacaaaattcagatcactccctgtatagcgacaacagcttaatgcttacaggataaggctttaagggtcatcttgcactattctactcttatctaggttcgacccctacctcaatttattgtgcccgtagtacctaaatttgatctcttttgaaccacgccgaattttggcttttcaccgttgttttaaaggtggtacagtctaggggaatgcctagccaagagcctaatacttgcaagtcttgatcaaagatttttttgagatatgctaaccgttcgttgctaagttgaggacgttttttcatactccagaggcttcttatccaggttcgtaaagatttaggaattagccagcggcgtagctgctttaatcccggtgcttcgactaaaaagtctcgccagcctgagatgcgtatgcgatcgctggatacattttgcggatttaattcttgccaaatgggagttccttgatagccaataaagttacaaacccgttctaactctgcctgggaatgggctaacatccgttcaaaaaagacaggtaacacccgctcacgtccaaactgctcaaagtagggttgtaattgcttgctataaagactgtattcgatcatctctgggacctgcaggaaagacataatcgattcacaaaaaataggcacacgaaaaacaagttaagggatgcagtttatgcatcccttaacttacttattaaataatttatagctattgaaaagagataagaattgttcaaagctaatattgtttaaatcgtcaattcctgcatgttttaaggaattgttaaattgattttttgtaaatattttcttgtattctttgttaacccatttcataacgaaataattatacttttgtttatctttgtgtgatattcttgatttttttctacttaatctgataagtgagctattcactttaggtttaggatgaaaatattctcttggaaccatacttaatatagaaatatcaacttctgccattaaaagtaatgccaatgagcgttttgtatttaataatcttttagcaaacccgtattccacgattaaataaatctcattagctatactatcaaaaacaattttgcgtattatatccgtacttatgttataaggtatattaccatatattttataggattggtttttaggaaatttaaactgcaatatatccttgtttaaaacttggaaattatcgtgatcaacaagtttattttctgtagttttgcataatttatggtctatttcaatggcagttacgaaattacacctctttactaattcaagggtaaaatggccttttcctgagccgatttcaaagatattatcatgttcatttaatcttatatttgtcattattttatctatattatgttttgaagtaataaagttttgactgtgttttatatttttctcgttcattataaccctctttaatttggttatatgaattttgcttattaacgattcattataaccacttattttttgtttggttgataatgaactgtgctgattacaaaaatactaaaaatgcccatattttttcctccttataaaattagtataattatagcacgagctctgataaatatgaacatgatgagtgatcgttaaatttatactgcaatcggatgcgattattgaataaaagatatgagagatttatctaatttcttttttcttgtaaaaaaagaaagttcttaaaggttttatagttttggtcgtagagcacacgggtcgacctagagtcagcacctgtttcagttgcgggcgtaaactccaccccaataattcaacccctttatcctttgcttgttgtgacaattggcggaggtaaacgatcgccgcactgtccaacacacgggtcttagcaaaatcgaacaccagccgacccacttgcgcctcagcctcaaaccattcagccaattgggactgaataaatgcaacttcctgttgacaaaagctttggggaacttcaatcagttgaatagtgctagccataggtaatcaccaaggagttagagaacaaaggcagtgtttaggtgaactcgtggttgccgtttaaccgcctatatctactgtctctcacccatatttacgtttaggcctaagccaatgtctaacttcttgaaaatgggttccaaaaattctctatcattgtaaacatggcaaaacgttcccttaaagcttcaccagatgggcaagcccaagccaagcaggcgatgttgtgccggggctggacccaggaatatttggcgatcgaagcgggtttatccacccgtaattccgtgtggaagtttttgaccggtcgcccggttgaccgcaatatttttatggaaatctgttttcaattggatttagactggcaagacattgctgatctaccaacgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 167 - DNA, 23 bp, Artificial Sequence
  EPSKOscreen-F
cgtcagttacctcgctaatcatg

SEQ ID NO: 168 - DNA, 24 bp, Artificial Sequence
  EPSKOscreen-R
caccaggtatcgactaggactttg

SEQ ID NO: 169 - DNA, 18543 bp, Artificial Sequence
  Ssp6803 EPS KO PCR Screen - Wild type
cgtcagttacctcgctaatcatgctggcggacacctttgccccatagagttcctccaattgaggactgatatctcgagtactcatcccacgcgcatacaaagcaaggattttctcatctaatcccgcgatgcgacgctcatttttgggcactagcactggctcaaattttccctgccggtctcgggggatggccaattccatttctccttgctccgactgtactgttttctttgagtacccgttgcgactattgcgcttctcttcctctgcctgattttttaagtgatgactcagttccccagccaatgcacgctctatcaagcgtttggttagttgttttagtagtcctgattctcccagtatttcttccggggtttgatactcttccagcaactcgtctagtaaggtatccacacaatttgcttcttgtttttttgtaccataaaggggtgtcctccttttgattggattttactccccttacacaaaattcagatcactccctgtatagcgacaacagcttaatgcttacaggataaggctttaagggtcatcttgcactattctactcttatctaggttcgacccctacctcaatttattgtgcccgtagtacctaaatttgatctcttttgaaccacgccgaattttggcttttcaccgttgttttaaaggtggtacagtctaggggaatgcctagccaagagcctaatacttgcaagtcttgatcaaagatttttttgagatatgctaaccgttcgttgctaagttgaggacgttttttcatactccagaggcttcttatccaggttcgtaaagatttaggaattagccagcggcgtagctgctttaatcccggtgcttcgactaaaaagtctcgccagcctgagatgcgtatgcgatcgctggatacattttgcggatttaattcttgccaaatgggagttccttgatagccaataaagttacaaacccgttctaactctgcctgggaatgggctaacatccgttcaaaaaagacaggtaacacccgctcacgtccaaactgctcaaagtagggttgtaattgcttgctataaagactgtattcgatcatctctgggaactgatcgatcgccgtgttaatgtccgtatttaccacccgttgggtccattcatggatatattgtgacaccaggcgatcgatgggatgacgcatcacataaataaatttggtctggggaaatgcctctgctaaacgttttacggtgtcagggtaggtgggcaatttcgtgtaatgggtgctggactcaccacagagatcctggggctgggccccggcaaaaagggactggtagtagtccatcccctttgcgaactcctcatcattgctgaaaaaattgggttccttcagcgaagtcataaaaatccccggttgcagagccagttgttcgtggagggtactggtggcacatttcatgccgccgataatgataaaatcggggccttttggatgatctgtagttggggagcagtccgtcatagtgctgtgaacattgggttaaattcctgatagttttcagtatgcttccccaccgcttttgtcgatgtttacgaaatgtttaactttggaaattctactccggacggtagggctttaacggttgtcgccattgaaaccaaatatcttgccattggcgatcgcaggtgtggggttctttctggcccagaatttcccgtagggcggcaatgccccatccccccaaccaacctaaattagccagggctaaacctagggggccataaaatttggcaaagtagcgcgatcgggacgcatatagatagggccggggacgtttacggctggccacatcggatttcactgaaccactacccccccgtaggtgtaccacactggcctggggaatatagcgaattttccaggcagcttgacgggcgcggcgacaataatcaatatcgtcgtagtacataaaataaccgtcatccattaagccaatttgttcaaccaccgatcgccggatgagaacacaggcaaaacttgtccactgcggttcaaaggactgttctgtgacggggatgggcacatcaaagggttgcaagagtttagtaattacactggtacgggccccatcaatcatttcactcaacggtgaatgatcccgaaaacaactaatttggggagtgccatcgggccattccaagcggggactgaacagtcccgcctctggatactgttctagggctactaataaggtttgaattgcccctggccgcacaatggtatcgctattgaggagtagataattctccgctcgaattgcctggattcccaaattattgcccgctgaaaaaccaccattaacatccgaaggcaacagccttacccaatcttgccaattattgttggcgatcgccttttcaatctcttccaccgagtcatcccccgaggcattatcaactacaattacttgctgggtttgggggtcaatttgggatactaatgatgccaaacaatccactacaagctggggggtacggtaattgagaataacaacggcaagctgatacaaatcccagctattgtttgaagcaattatggccataatcttgcaaatactcttagcaactagagggaaaaaagaacttcctagacagctactttttggtaaatattcttagctttgcgggccagattgacaatattggtggcggcgggccagcgatcaaaccattggcgaggggcaatactactacaggaagcccgttgaaatcctaatggaattgaggcgactaaggttttgatctggggattttgttggcgaaaggtggaataagctccatccacatgcatggggccgccatcgggatgaccaccgggacgttctagcaatgtttctaaaaagtcgatcaactggtcaaaaatacggctatggatggcgagaaaatgggcttgaataattggctcatcatagagatgcaaaagggagtttgtgttagctgaaacattatgaccgaagtaaacaaagtcccaggaagtcgtttgtaactcttgcagtaattgggtttgattttgaactaagtcttttgtaaatgtggcatcatcttccaataggagaacctgttccaagttttgggctttggccactttcaaaactcccaaatgacttagaaaacaccccctggcccccaggctcggaaaatttccttggtctgatggctttaccgctgtaaaaaatgcagcatttttgggcaaaccaagaattttaaaccgctgaaactcttggatcatttcccgacggcgatcacctcgttcggctaggttaataatgtatgtgccatcaaaatagttgaagaaagcggaagacatggaataccttttaataagttgcttagaatctgtttgtaaagtcggattctgccccctaaatcccccaatactgggggactttgatttagtttccccccaaacttgggggaccaggggggcttttcaaacacgctcttagggcggggaaaaagtaatgaaattgcagtaagagtaccgaaatctatttgatatattccaagtcaatttggttgattttcagttgtattctgtcccgccacgcccgaagtggtaaacgactggtaatgtaatttaaagtaaacaagactgccccgtaacgctgtaaacgaaagtttgcccgggcccaccaatcctgcaatttaagagattttatttgactacttgtaagctggatcgtgggcagtccactggcttcatagccgcgttgcaacaacaaatccccaactcgggattccaccagttgaatttcccgatcgcctaatttgcgtcgccattgattgagaaaactactatcgggttggtcataggttgtgtcttggttgtactgcaacatcgccgggtcgtaggcgacccctaaaaaattggccagttgggtcaatacagtttggggctcacgaattaggttttcgtaactgatctcaacgtagttattaaccggtagagtttgcttcaacgcctcccaatcttgctctgcttccagccagcgttgggaaccagtccacacattacccgcccagcccataccgatgcaggagcgggccacatcccggggatcccgcacaatatgaataaaacgggcattgggccaaatggccaacaggcgatcgaagtgtcggtgtaccgttgcccccaccactggcttctgttcctgagcttgtttttgctgtaaaaagctttgcaccaattccccataggtcaagttaggggaaacctcaaacccagtagcctgaaaaatacgatgggtctttaaccaatcctgatagtcagatactttgggaaattgagcattatcacttacctgatcgatgacatattcaaactcattacaccaggcaatttgcgaatggtgagacagcatcaagcgtagcagagttgtgccagaacgttcggcaccgatgagaaaggtgggggattcgaggaaagaagtgttcatgggggcgtgacggcgatcgtgagatgggcaattgcaacctgttcttagcttgatggatcgctgtctgatttcgtgcctgccctatgtacaactttgcgtctaactttagaccttttgcctgaccctgactttgagcgccccggcttggttttgagtttcccctgctcactagatttctgcttctgtttttttacctgtttaaccgctggcgatcgggactggggctttaaagattccggtggttgtaaacataatcccgctaaaccaccactaatcaggggaaaaatcggattatacatattgttaatcacagaatccaacttaaacagcaccagacaggtggccagggcggcggcgggggcaactttcggatggagccataacttagcgggatagcgaaatgtggcaaaaacggccgggggtaagagcagggctagggttaagttcagcaggccaaaggctccttgaatgccaaaggcaataatccagaggctatcggtcacagacacatcgacaatttcgccgatccagttttcttcatagacccgattgcgtttccagcccgcccaaccaaaccaaaatcgctctcgggctttttccgctaaaatctcctcatttatccagcgaaagcccagggattgaatgcgatcaggattggtatattcacttaaaaaagcgagaattttatccccatggaactgaccggtcacattcatatagaggaaccagccaaggccaaaaattaaaatgagtaggggcaagtttgattttagaaatttagcagtaaagagaataatcaagccatagaaaaaataaccataggcccctgtcgagcggcaccagatcacggtaaacaccaggaccggaatcaatgatttaatttcgtaattccaaattttggtaaaggttttggactgccagagccagatggtaattaatgctactgtcatcatccacatccccaccatcaagccatgttgcataaacccattgggacgatagccaccgtagcgaatggcctgactaatgccggaaggatgggcataatagccataaacaatcaggtgcaaattgggactcatgcgtccttcccagaggcagatgggcacataaattaaacctgctttaataatgccttcagccaattgtttgagataaattaggcgattaaagtacagcttgcccaacatatagggtaagccccaaaccacagtttgagtgatggattcattaacgccgtcataggcccctaaaccattggtaacagaggacataaatggagaaatacaccacaacatcatgggtatatccagccattcaatccgaaattttttcagccgttccaaatcatggatacaaagccccaccacaatgccgtaacaggtggcgaccatgccctgatagtcggggataagcggcaaagcaaagccagtacgttgcggcagaaaaagtaagcctcccaaaaagctgaccatgacagcggtacggggagggtagcgtcgaaagaaatacagaataactggtaaccacagcaggagaaccagttgggcttggggggtcatggatcgtttgctgttgccatggttgcttcctctaaagcctgttcaaataaggtggtggcatcatcccaactgtagcaactggcagtctggtaggccttgtccgacaacgtttgccattgttcaaggggttgagtgcagattttgacaatggctgcggcgatctccgctggatcttcagggggtactaaaatcccacctccctgctctatcagttccggggccgctcccgtgggggtcccaatcacaggggtgcggcaggccatggcttctaaaataggtaaaccaaacccctccaaccgactggtaaacagccaggcatcacagcttgcataaatttcttttaacttctcctgagcaactttgtgatgataggcgatcgcctccggcaaaggtaaattgctggaaacaggttcagaaccaaaggcaatgccctttaaatttggtaatttttcctgagctagttgccaaccctgaatcgccaaatccgttcctttccaagctttagtggagtacataaagccaacggtgggtacagtttgacggccccggggggacgctgagaataactccaaatcaacactattgggcacaagggagacttgggaatccccatattcctctgccatcacctttttcagccactcggcaatgacgattttatacagcggcaaacgataggtggccttaactcgctcgacgggaaaatagggatgtatttcatggtgttggacaaagtaaactttttgccctttgctcggtgaaagtttagctacccactcagcggttccccaccaggtagcaatcaccacatccccatctggtaaatcccgatcgccaacggcacgacaggtttccagcactttatggggtacgtttaacccgtcaaaatgggaggcggacggctgagcaggggtctttttcccccgaagccattggctaattctctgctttattccaggtttaggtagaggctgggaaattataaatacctcatggcctcgtttttgcaggcgatcggcataaatggccaccacccgaatgccccccgctaaaccggcatagggtaaaacaaaggtgattttcatactcctaactccataacgcttcaatcggtaaacccagtcccagactccagcgaattgtgatcaaaagactagcaacccccagtagtaatagagtggagagtaaatcttggcgaaaaccactcaatttttcctgccaaaccccgtaagccactgctagatagtacggcagatcattggccgccaccacaatcaccgcccctaaaaccccaaagctgtgaaaccccaggggaataaaaatcagcatataggcaaatttggcaaagttaccgatcgccactaattgaggcttacctagggcatagaggacaggatcaatagttaaagccagggttggtaaccataaaccggccgctaggatgggtaacatccaggccccagcccgatagcgttcatcgtagagaaaaagaataagccaatcgccaaaactgatcatcacagcaatggcgatcgccagcgcccctagtaataaccagcgttttttaaggattttactgcgtaactcagcccggggtaagtctatttgttgggaaattacgggaaacatgaccttgccattgactcgactcaaaacttgccggggtagttctgccagggtaaaggcgatggtataaacccccagtaaggttaggctgaaaattttccctagaatcaggcgatcggcctgggtggcgagaaaggtcatggctgtggaaacaaaaatccagcggccaaagcgagcaatttcttgtaaagcagtgggatcccaggtaaagcgattgcggggttcagccaccaggtaatgactccaaatcattttcaccagactgagcacaaaattacccatcaccaacgcccaaatggtgggattgaaccaggcccagacaatcatcaccaccagcccaattgactgcacgatgaattcaaaacgggtcagcttgcccagatcaattttgcggttgagggtaaataatgccgtggagttaaaccccgcaatgatggtagaaaaccccaccaagggtagtaaccaaattagttggcgatcgccataaaaacgggaaaccggtagggcaataaggcaacaacagagccatagcccaacaccccgtataacctgaatagtccaagccgtgttgagaaaactaggctcatccccccgtttgttttggataatgctggggccaatgccaatatcagaaaataaattgagaccaatgataaaggtatttaccaacgccatcaggccaaacatttccggcaccaacaaacgagtcagcaccagattacccgccagtctgagcacctgactagaaccatagccaacaaaagtccaaatggtgccacgaatggccagtttattgagggaagccatagttacggcgccgatgcgtaggtgtgaaaatgctgggctaatttttcagcctctttatgaacatcatgatccatctgcaccgcttgctgacccattgcggccatggcggtaagttgttcacaagacatagttaaaacagactgcattgcttctactaaatcaggaatggagcctgggggcacaagccagccggaaacccccggtttgaccagttccggtatgccggccacataggtgctgatcaccggacgacccagggcaaaggcttccataattaccaccggtaaaccttcggcgaaactcggcaaaaccatggcccgggaagctaataaatgttgctgcaccatggcactactggcccagccagtaatagtaatgttttcttcgagttgatattgctcaattaattcttcaatgggcgatcgcagttccccatcccccactaaaaccagctttaccgcaataccgttatcccgtaattgtcgcactgcttgtactaaaagcaattgccctttttgttcacacagtcggcctacacagactagttgcggaacctctggtaccggggtgatttcttgttggagataatccgccgccaatgcacaatggactacttgaattttgggccaatctgccaagctacaccagcggtaaagttgacttttgccgtaggaactaatggccaccacaaagcgggcccggctaattttttcgggaatggcgatcgcctccggtcggtcaaattcctccgggccatggacggtaaaactataactaatgtctcctaaactggcacagagcatagcaacggtggtggagttggtgccgaagtgggcatggatatgggtaatacccgccgctttgagccaccgccacagcagacaagcttccaagaaataggcaaaatggcgcagtagtccccggtgcgatcgccgacccacttgtatggttaagccgagggttttcagccatgggggcaggcgggagattgctaaaaaaagaccactccctagtaagggtatcaatccagcccccagcagtgcccgagttcgttgacattcctggcgatcggcttcgtctgctaaatcagtctgggcaatgggtcgaacagaaatacgctctacgacaacaccaagctcttccaaagccagaatttcacgacgaatgaaactatgactaatcttggggtactgattaatcagatatgcaactttcataaattcttgcacgagttttcttttccattgattggacccacctaagtgaattttgacttcctttactgcctccaaggctagttgtgcccggaattggggcgatctcaccattagccccgaatcaattatcctaaaaagtagcagggaggagtccgtgacgttgcaagtccttcaatcaatcccaaaggagtttaacccatcatgccaacagttgaaactgacttggcccaaatcctggaaaggatagacggcaagctagaccgaattgaaaaagacatcagtgacattaaagtttcccaagcagaagttaaaggggaaatcaggacccttgacgaaagactctctggacagataaaagctaccgatgaaaaactatccggacagataaaaaccaccgatgaaaaactctctggacaaataaaaacccttgacgaaagactctctggcgagataagcacccttgatgaaaaggtcactggcattggcaagcgtctggaaaatcaggaatttaccagcagaggcattctgacagctttaatcattgctctcattgcaggagccgctaaattctttggcatcttccctaatccctaaccgtcaatccctcagatggtggcgattacccctaggacaggaatttgaaacttttctaccgttgttaaagcctggtgagtttgggactgggacgtatatttaaggcgaactattagacagactccatcagtacgattcaaaagaaagggggtatctgggacagttaacaatggggcgttatagatgaccaaatcatatttgtgggtcaaggtttggagtgccgggtcgaggcgactcagccagcgctgtaaacgaatgggatggccagcgttcattgtgccaacagggatgattgccaaaccgtcctcatagtggactagattaagtaactgttgcgggtcggtatcgctatttaaaacattgaccagtccctgctccaattcatcagtattattgccatggtgatgaatgtcgggatgttgcaaattggtatctatcaccaaaacagtctgaccagcattgactgcggcccgggcaaattgcatcgtcacagatgcttgaccactttcgttatcgatcgccgtcatggccatggaacgaataccttgctcttgatactgaaaataaaaattggtgtaaatttgctggcccctatcctcccccatggcaacaatcgcctcatttgcttctgtgggcaaaacttcgtcttctaaagcatctttatcatgggcaattcctgaatccagcagcggcaattccccccaaacggagtaacccaagccaaatttaaggtcgctgttgctgtaaaaaatattccgactcctttcccaggcgatcgccagcagcaatcccaaaactaggccgctccccataccagcaatcatttttttcttcggatcaggggggaaagaaatcggcaaaccatcgggcccccggggaatagctggtgcagaaatgattttccaagggacatcctgttgggccgcttccacccgcaacgtttcccgttgattggctaatgtatccagtaaccctttctttaaatcaagctgtcgtgccacctcatcgtattgagccgcaatggtgggaaattgatctaagttaatccgaagacgctcttggttagccaccagaacttgccggcgagttaagcgtttagcaatttcattttgcgtcacaattaactggtccagcatggtaattcggctggtattctgaaacataaaaatattggggttattatcaccttttagggagctagatttgagaatttctttagttctagtttctaaaagagtttgcagattgttccgtttttgaaacaagtcctgcattatgggattttcattggtgaaacgactggattcggcggcaatcatcgtttctacttcttgcaattgctgtaacagattttggcgctctggattttggctcagatcaaggacaaccaatgcttctgatggtgaaagccctaaagttgattctaggtttgattttaatgatcttaattcttccagctcttcatcaattttctggatatcgagttgattagcttgataagcctcgttgagattagtggcctgttgattggggctaattatgttatagcgctgttgtagggtccgctgttgtccttgcaaggcgcggatttgggtttctaaaattggaatttgttcatcaataaagctcacaccagcttgtaaactattttcccgttcctgcagactatattgtaaatattgctcggcagttacctttaaaacagtctccaccaaaacggcatcattgccttcatagattacttcaaggatttttgtatagtcgaagcggctatttccttcttgcacacgcttgacaattaaatttttctgcaaattttgtaacattgctgcttctggaatctgggggagaatattatgaacttcagcggcaatttttgacaacagtaccgtacttttaaggatttttagttgggtgggataatcaaggtttaaaagttcttgactgggtaaatcattgctacgggttaatacagaggcatctgttagcttttctgctgatgtaactggttcaattaagatttcaaagcggcccacataggtggaggggtcctgggtactcagataagaagtaaccactaagccagccccggcaaaagcgacaatgataaaccactttcgcaaaacaaggttgagataaacccgcaccaaatttttcgaagttgctgggggtgagactgcctcaatctctgcttcttctgttgctaaaaattcttctgcttcatcgtgagccatggaatattcgggcgctttgagagatctttatgggagcggagactcgaagctgaacggtgatcttagtggcgatcagcggcacactcagagtatagcaaggaactaaatggcctaattttcttaagttaaacaccggtcaagcacgaagttagacggcgcccagtaatcatagcaatgcggacgttaagaccgagctaatccaacctattctcagtgccatggtggcgatcgccaaacttagtgcttcccaacctgggagggtgaaaaccttgtcagaacatcctttcccctatcctcagcaagttactttacccagttggcagttgaaaaactcaaaaacggcgatcgttgctggcaagtcccctggtcaacgctatatcttgcaaaaaggggatataactgccaccatcaccgcttgcctcaatccgaatgcccccagtaccctcacagagcaacaatttatcagcaataaatatcgccataaccttcatttttttgcctggttagctggacaaaaagatttaacggatagcagttgtttatggaccctcatctccgccccgatcgccccggatgcaactccggatgagattactcaaacctttcaacaattggaaacggcctgggtagagtggtatcaatggtggcaactccactaaactccccaagcaaccacctccatagttaacctccactaaccaccatggaagatttaggaattgtcgttattgggcgcaacgaaggcgatcgcctcaaggactgtctgcgatcggtggtagaagctggcctggttatttatgttgattccggctccaccgataacagtattgaatttgcagaatctctcgatgttgtggttgtccgtcttgatttagcgcaacccttcactgccgcccgggcccgcaatgctggcttggccaaattattagaactacagcgaagtaccaaatatgtacagtttgttgatggtgattgtgaagttattaccaattggttagcaacagcctatcagtttttagaagagaatagggcgatcgccgtggtttgtggtcggcgcagggaacgctacccggagcaatcaatttataatcagctctgcgatctggaatgggatacgcctgtgggtcagacgaaagcctgcggcggagatgccatggtgcgagtgacagcatttcaaacggtagggggatttaacgagggattaattgctggggaagaaccagaactctgtgtacgtttgcgacaacagcagtggcaaatttggcgcttggataccgaaatgacttggcatgatgccaacatgttgcattggcaccagtggtggaaacgccatgttcgtgctgggttcgcctttgccgaaggagcgtggctccatggtcaaccaccagagaagcattgggttaaagaaagccgcagtatttggttctgggcattgatcattccagttgtcagtctgggatctagttgccccactttcggtctgagcttagttttgctgttgggttacccgttgattatctataaaacggcacggtattttcagcaacaaggattatccgcccagttagcctggctctatgccacttcctgtctgctagccaaatttccccagttcattggccaactgcgttttcactggctccgcctcaccaaacaaacagcgacgattgttgaatataaagctcgatcataaagttatacggtgcgtaaacaaaacatagacatgagcttaaacagtcctgctcgaagatgaaagtgtcatcaaaaaaacaccggggctaagcaatgaattccatcacgcttctcaacacaacgatccataactactccatggttgagttacttgaagatctcaataagcgtggtggatttgtggttacgccaaatgtggatcacatggttaagttgcaggaagatgctgagctgcaagaggtttaccaagtggcagattaccgagtttgtgatagcaaaatcattgaatacattctcaaactgttaggtacaccgattaaagagaaaatctctggttctgacttgtttcctgctttttatgaatacaacaaagacaatactgataccaaaatctttctgctcggtgctaaagaaggggtagccgatcgcgctcgccaaaaaatcaatgaaaaagtaggccgagagatgattgttgattcctattcccctagcttcggctttgagcaaaatcctgaagaatgtgcctacattctagagcgcatcaaacaatccggtgccaccgtgttagcagtgggtcttggggctcccaagcaagaaaagtggattgctaaatatcgtcatcaactgcccaatatcaaaatttttctggcgatcggcgctaccatcgacttcgaagcgggtgaaaaagcccgttccccccaatggatgagcaaagtcgggttggagtggctccaccgcttagcctctgaacctcagcggttatggaagcgttacttggtggaaagcctaccgttctttgccttggtgttacagtacaaactgcaaacccttctgtctgagcctgcttatcctcagttatctactgctgattctcggaccgtttaggtgtttcggggttgcctagccaaagaatggggaaattttgagggaagatcgccctgtcctatagcgattagagtgttggataacttaaacgatctaacattgccacaggtctcgtttcattctcctctcagttctcagcttgccgctatgctcatcaccgttttcatttcggcgatcgccgttgttgtccttgtgcccagtgccattctgttgttggagtgtggtgcagcttgtttagctccctcggaaagaactcaggcggttccaggtaatcaagccagaacgccagcgggattgcgggttgcggtgttggttcctgcccacaacgaagcccaggtcattgcggaaacattgcaaagtattcagccccagcttactcccgcagataccttactggtggtagcggacaattgcaccgataccacggctattattgccgaaagagaaggggctacagtgattgaaagaattgatcaagaaaagcggggcaaaggctatgcgttggattatggggtgcagtacctagcccaacacagggaaccggacattgttattcttatggatgcagattgttacgttcatccaaactgtattgaacaactaaccaccatggcggcgcaacgacagcgaccgattcaaagctgttatgtcatggctacacccgcagaacccagcattaaggatcgactttccgcctttgcttttttggtaaaaaattgggtacggcccctcggattaagtcaactgggtgccccctgcctcctcacaggcactggcatggctttcccctggacgattctcaagaatgcccccctggccagcgataatattgtcgaagatatgcagttgggactggatttggcgatcgctggttatgcccccctgttttgtcccatggccctggttacggggttacttcctaaagcccaggacaccgctatacaacaaagaacccgctgggaacacggacatttaaaaacttttattagccaagctcctcggttgctgaaagccgctattgggcaagttcgtctggatctcctggctctggtgggagaattgagcattccgcccatctctttcctagttttactctggttaacttacgctttcgtcagtttactagcaagtttggcaagtgacagttatctgccccttttattagcgaccatcgctggggccatgttgggaatggcaattttgctggcttggatgaaggcagcccaggaaatactgccctttaccaccctgttaatgacccctctatacctattgtggaaaattcctctttatttcaactttttcaggaaaccccaaaccaactggaataaaacaaaacgggacacggcgatcggaaaacgggatacttaaaataaacccagttggaactaggtttatgttaaagaaatacagaatggctaaaatggcccaacgggcactgtcttcttaaggagtgaggtgatgaaaacctctacacgtcaggatttctgaaatttgaacagggcggtcaataaatcccatagccatggccggagtggtatttttcctcagacttccatagggacgagttcaattgtgaagcaacctctggacattaagggctctctgcaacccctccagttccttggcatagtggttttgtcgccgttgtagggcactattcaatgcttctaaatgattggtatgtactgctgacgatgggctaattggcataaattgtccaaccttccgactgttcgggggggggaagcttctcacccactcgggtgtagagttcatcttcttattctcagtatcccaagacggcatttgcgttgatatctatgcaattgtctgtttaacgtttctggacctgtacctaaaaccccattacttttctcacggacccctagaatcgaagagatttttggcacgattgcggtgctactttgagacaaacctacctagcaagcgccactacgttttgaaaaaacgacttggatggttttcaaaattagtttgatgtcatagcccaagctccagcgtttctgatagttaagatccatttccacaacttgatcgaagtttaagactgtagagcgaccattaacttgccattctccggttaagccgggtttcacttctaagcgattgctctggtgggagttatactgggcaacttcatccaaagtggggggacgggtgccgactaagctcatctcgccgattaaaacattccagaactgagcaaattcatcgaggctagttttgcggagaaatttgccgactttggtaatgcgggggtcgttggtatttttaaagaaagcaccatcaatttcattctcaacttgatgcttcagggcttcagcgttggttaccatggagcgaaatttccagattttgaattgttgacccttataaccacagcgggtttggctaaacagtaccggaccagggctatctaatttaatggcgatcgccaggggaataaagaggacggaggtaatggtcaaccccaccaatgcaccgacaatgtctaataaccgtttccctttggaaatgacagaaggatgaacctgttgatcaaaagctacatcgacattatcgccaaagacttgattggttgtttcagtaaaggtgaaatattgatcaattcctgctagagtcagcacctgtttcagttgcgggcgtaaactccaccccaataattcaacccctttatcctttgcttgttgtgacaattggcggaggtaaacgatcgccgcactgtccaacacacgggtcttagcaaaatcgaacaccagccgacccacttgcgcctcagcctcaaaccattcagccaattgggactgaataaatgcaacttcctgttgacaaaagctttggggaacttcaatcagttgaatagtgctagccataggtaatcaccaaggagttagagaacaaaggcagtgtttaggtgaactcgtggttgccgtttaaccgcctatatctactgtctctcacccatatttacgtttaggcctaagccaatgtctaacttcttgaaaatgggttccaaaaattctctatcattgtaaacatggcaaaacgttcccttaaagcttcaccagatgggcaagcccaagccaagcaggcgatgttgtgccggggctggacccaggaatatttggcgatcgaagcgggtttatccacccgtaattccgtgtggaagtttttgaccggtcgcccggttgaccgcaatatttttatggaaatctgttttcaattggatttagactggcaagacattgctgatctaccaacgtttccgcttgaaaaagttaaagcaacggaaccagtcgacaggccagtaacggatgaatcccttaagactaccacgatccccgatgtccctgatttagcgataatcaaaacaaaattcaaagtcctagtcgatacctggtg

SEQ ID NO: 170 - DNA, 3033 bp, Artificial Sequence
  Ssp6803 EPS KO PCR Screen - MLS
cgtcagttacctcgctaatcatgctggcggacacctttgccccatagagttcctccaattgaggactgatatctcgagtactcatcccacgcgcatacaaagcaaggattttctcatctaatcccgcgatgcgacgctcatttttgggcactagcactggctcaaattttccctgccggtctcgggggatggccaattccatttctccttgctccgactgtactgttttctttgagtacccgttgcgactattgcgcttctcttcctctgcctgattttttaagtgatgactcagttccccagccaatgcacgctctatcaagcgtttggttagttgttttagtagtcctgattctcccagtatttcttccggggtttgatactcttccagcaactcgtctagtaaggtatccacacaatttgcttcttgtttttttgtaccataaaggggtgtcctccttttgattggattttactccccttacacaaaattcagatcactccctgtatagcgacaacagcttaatgcttacaggataaggctttaagggtcatcttgcactattctactcttatctaggttcgacccctacctcaatttattgtgcccgtagtacctaaatttgatctcttttgaaccacgccgaattttggcttttcaccgttgttttaaaggtggtacagtctaggggaatgcctagccaagagcctaatacttgcaagtcttgatcaaagatttttttgagatatgctaaccgttcgttgctaagttgaggacgttttttcatactccagaggcttcttatccaggttcgtaaagatttaggaattagccagcggcgtagctgctttaatcccggtgcttcgactaaaaagtctcgccagcctgagatgcgtatgcgatcgctggatacattttgcggatttaattcttgccaaatgggagttccttgatagccaataaagttacaaacccgttctaactctgcctgggaatgggctaacatccgttcaaaaaagacaggtaacacccgctcacgtccaaactgctcaaagtagggttgtaattgcttgctataaagactgtattcgatcatctctgggacctgcaggaaagacataatcgattcacaaaaaataggcacacgaaaaacaagttaagggatgcagtttatgcatcccttaacttacttattaaataatttatagctattgaaaagagataagaattgttcaaagctaatattgtttaaatcgtcaattcctgcatgttttaaggaattgttaaattgattttttgtaaatattttcttgtattctttgttaacccatttcataacgaaataattatacttttgtttatctttgtgtgatattcttgatttttttctacttaatctgataagtgagctattcactttaggtttaggatgaaaatattctcttggaaccatacttaatatagaaatatcaacttctgccattaaaagtaatgccaatgagcgttttgtatttaataatcttttagcaaacccgtattccacgattaaataaatctcattagctatactatcaaaaacaattttgcgtattatatccgtacttatgttataaggtatattaccatatattttataggattggtttttaggaaatttaaactgcaatatatccttgtttaaaacttggaaattatcgtgatcaacaagtttattttctgtagttttgcataatttatggtctatttcaatggcagttacgaaattacacctctttactaattcaagggtaaaatggccttttcctgagccgatttcaaagatattatcatgttcatttaatcttatatttgtcattattttatctatattatgttttgaagtaataaagttttgactgtgttttatatttttctcgttcattataaccctctttaatttggttatatgaattttgcttattaacgattcattataaccacttattttttgtttggttgataatgaactgtgctgattacaaaaatactaaaaatgcccatattttttcctccttataaaattagtataattatagcacgagctctgataaatatgaacatgatgagtgatcgttaaatttatactgcaatcggatgcgattattgaataaaagatatgagagatttatctaatttcttttttcttgtaaaaaaagaaagttcttaaaggttttatagttttggtcgtagagcacacgggtcgacctagagtcagcacctgtttcagttgcgggcgtaaactccaccccaataattcaacccctttatcctttgcttgttgtgacaattggcggaggtaaacgatcgccgcactgtccaacacacgggtcttagcaaaatcgaacaccagccgacccacttgcgcctcagcctcaaaccattcagccaattgggactgaataaatgcaacttcctgttgacaaaagctttggggaacttcaatcagttgaatagtgctagccataggtaatcaccaaggagttagagaacaaaggcagtgtttaggtgaactcgtggttgccgtttaaccgcctatatctactgtctctcacccatatttacgtttaggcctaagccaatgtctaacttcttgaaaatgggttccaaaaattctctatcattgtaaacatggcaaaacgttcccttaaagcttcaccagatgggcaagcccaagccaagcaggcgatgttgtgccggggctggacccaggaatatttggcgatcgaagcgggtttatccacccgtaattccgtgtggaagtttttgaccggtcgcccggttgaccgcaatatttttatggaaatctgttttcaattggatttagactggcaagacattgctgatctaccaacgtttccgcttgaaaaagttaaagcaacggaaccagtcgacaggccagtaacggatgaatcccttaagactaccacgatccccgatgtccctgatttagcgataatcaaaacaaaattcaaagtcctagtcgatacctggtg

SEQ ID NO: 171 - DNA, 11757 bp, Artificial Sequence
  pLybAL50
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggtcgactctagatggctacgagggcagacagtaagtggatttaccataatcccttaattgtacgcaccgctaaaacgcgttcagcgcgatcacggcagcagacaggtaaaaatggcaacaaaccaccctaaaaactgcgcgatcgcgcctgataaattttaaccgtatgaatacctatgcaaccagagggtacaggccacattacccccacttaatccactgaagctgccatttttcatggtttcaccatcccagcgaagggccatgcatgcatcgaaattaatacgacgaaattaatacgactcactatagggcaattgttatcagctatgcgccgaccagaacaccttgccgatcagccaaacgtctcttcaggccactgactagcgataactttccccacaacggaacaactctcactgcatgggatcattgggtactgtgggtttagtggttgtaaaaacacctgaccgctatccctgatcagtttcttgaaggtaaactcatcacccccaagtctggctatgcagaaatcacctggctcaacagcctgctcagggtcaacgagaattaacattccgtcaggaaagcttggcttggagcctgttggtgcggtcatggaattaccttcaacctcaagccagaatgcagaatcactggctttcttggttgtgcttacccatctctccgcatcacctttggtaaaggttctaagcttaggtgagaacatccctgcctgaacatgagaaaaaacagggtactcatactcacttctaagtgacggctgcatactaaccgcttcatacatctcgtagatttctctggcgattgaagggctaaattcttcaacgctaactttgagaatttttgtaagcaatgcggcgttataagcatttaatgcattgatgccattaaataaagcaccaacgcctgactgccccatccccatcttgtctgcgacagattcctgggataagccaagttcatttttctttttttcataaattgctttaaggcgacgtgcgtcctcaagctgctcttgtgttaatggtttcttttttgtgctcatacgttaaatctatcaccgcaagggataaatatctaacaccgtgcgtgttgactattttacctctggcggtgataatggttgcatcttaagaaggaggatccatatggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttctagccatcaccatcaccatcattaaatcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 172 - DNA, 27 bp, Artificial Sequence
  E020-F
cattttcctgtcagtaacgagaaggtc

SEQ ID NO: 173 - DNA, 60 bp, Artificial Sequence
  E020-R
tatataatcgattcagtgatggtgatggtgatgtctagaaaggcgtccttgccacgcttc

SEQ ID NO: 174 - DNA, 1615 bp, Artificial Sequence
  E020 PCR
cattttcctgtcagtaacgagaaggtcgcgaattcaggcgctttttagactggtcgtaatgaacaattcttaagaaggagatatacatatgatcgtggaaacaaagtacggtcggttgcgcgggggaacaaatgaaggggttttctattggaaagggattccgtacgcgaaagcgccggtcggtgaacgccgttttttgccgccggaaccgcccgatgcatgggacggagtgcgtgaggcgacatcgtttggaccggtcgtcatgcagccgtccgattcgatgttcagccagctgctcggacggatgaatgaaccaatgagcgaggatgggttgtatctgaacatttggtcaccggcggcggatgggaagaagcgcccggtattgttttggattcatggcggcgcttttttattcggctccggttcatttccatggtatgatggaacggcgtttgccaaacacggcgatgtcgttgtcgtgacgatcaactaccggatgagcgtgtttggctttttgtatttgggagatgcgtttggcgaaacgtatgcccaggcgggaaatcttggcatattggatcaagtggcggcgctgcgctgggtgaaagagaacattgaggcgttcggcggtgatccggacaacattacgatttttggcgaatcagccggagcggcaagcgttggcgtgctgttgtcgcttccggaagcaagcgggctgtttcgacgcgctatattgcaaagcggatcgggttcgcttcttcttcgttctccggagacggcgatggctctgactgaacgcattttagaacgtgccggcatccgtccgggtgaccgcgatcggctgctgtcgattccagcagcagagctattgcaggcggcgatgtcgctcggcccaggaatcacgtacggtccggtggttgacggacatgtgttgcgacgccatccgatcgaagcgctccacgacggggcagcaagtgatattccaatcctaattggcgtgacgaaagacgaatacaatttgttttcattgactgatccgtcattgacaagactcgaagaaaaagaactgcttgaccggatgaaccgtgaggtcgggcctattccggaggaggcggtacgctattacgcggaaacagcggatcggtcggcacccgcgtggcaaacatggctgcgcatcatgacgtaccttgtttttgtcgacggaatgttgcgaacggcggatgcccaagcagcgcaaggggcgaatgtgtacatgtatcggtttgattatgaaacgccggcgtttggtggacaactgaaagcgtgccatacgctcgagttgccgtttgtgtttcataacctccatcagcctggtgtcgagaatttcgtcggcaaccgaccagagcgtgaggcgattgccagcgaaatgcatggtgcctggctttcgttcgcccacaccggcaacccgaacggcgctcatttaccagagaagtggcccgtatacacaaaagagcacaaaccggtgtttgtcttttcggctgcgagccatgtggaagacgatccgttcggtcgcgagcgggaagcgtggcaaggacgcctttctagacatcaccatcaccatcactgaatcgattatata

SEQ ID NO: 175 - DNA, 11118 bp, Artificial Sequence
  pLybAL68
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggtcgactctagatggctacgagggcagacagtaagtggatttaccataatcccttaattgtacgcaccgctaaaacgcgttcagcgcgatcacggcagcagacaggtaaaaatggcaacaaaccaccctaaaaactgcgcgatcgcgcctgataaattttaaccgtatgaatacctatgcaaccagagggtacaggccacattacccccacttaatccactgaagctgccatttttcatggtttcaccatcccagcgaagggccatgcatgcatcgaaattaatacgacgaaattaatacgactcactatagggcaattgttatcagctatgcgccgaccagaacaccttgccgatcagccaaacgtctcttcaggccactgactagcgataactttccccacaacggaacaactctcactgcatgggatcattgggtactgtgggtttagtggttgtaaaaacacctgaccgctatccctgatcagtttcttgaaggtaaactcatcacccccaagtctggctatgcagaaatcacctggctcaacagcctgctcagggtcaacgagaattaacattccgtcaggaaagcttggcttggagcctgttggtgcggtcatggaattaccttcaacctcaagccagaatgcagaatcactggctttcttggttgtgcttacccatctctccgcatcacctttggtaaaggttctaagcttaggtgagaacatccctgcctgaacatgagaaaaaacagggtactcatactcacttctaagtgacggctgcatactaaccgcttcatacatctcgtagatttctctggcgattgaagggctaaattcttcaacgctaactttgagaatttttgtaagcaatgcggcgttataagcatttaatgcattgatgccattaaataaagcaccaacgcctgactgccccatccccatcttgtctgcgacagattcctgggataagccaagttcatttttctttttttcataaattgctttaaggcgacgtgcgtcctcaagctgctcttgtgttaatggtttcttttttgtgctcatacgttaaatctatcaccgcaagggataaatatctaacaccgtgcgtgttgactattttacctctggcggtgataatggttgcatcttaagaaggaggatccatatgatcgtggaaacaaagtacggtcggttgcgcgggggaacaaatgaaggggttttctattggaaagggattccgtacgcgaaagcgccggtcggtgaacgccgttttttgccgccggaaccgcccgatgcatgggacggagtgcgtgaggcgacatcgtttggaccggtcgtcatgcagccgtccgattcgatgttcagccagctgctcggacggatgaatgaaccaatgagcgaggatgggttgtatctgaacatttggtcaccggcggcggatgggaagaagcgcccggtattgttttggattcatggcggcgcttttttattcggctccggttcatttccatggtatgatggaacggcgtttgccaaacacggcgatgtcgttgtcgtgacgatcaactaccggatgagcgtgtttggctttttgtatttgggagatgcgtttggcgaaacgtatgcccaggcgggaaatcttggcatattggatcaagtggcggcgctgcgctgggtgaaagagaacattgaggcgttcggcggtgatccggacaacattacgatttttggcgaatcagccggagcggcaagcgttggcgtgctgttgtcgcttccggaagcaagcgggctgtttcgacgcgctatattgcaaagcggatcgggttcgcttcttcttcgttctccggagacggcgatggctctgactgaacgcattttagaacgtgccggcatccgtccgggtgaccgcgatcggctgctgtcgattccagcagcagagctattgcaggcggcgatgtcgctcggcccaggaatcacgtacggtccggtggttgacggacatgtgttgcgacgccatccgatcgaagcgctccacgacggggcagcaagtgatattccaatcctaattggcgtgacgaaagacgaatacaatttgttttcattgactgatccgtcattgacaagactcgaagaaaaagaactgcttgaccggatgaaccgtgaggtcgggcctattccggaggaggcggtacgctattacgcggaaacagcggatcggtcggcacccgcgtggcaaacatggctgcgcatcatgacgtaccttgtttttgtcgacggaatgttgcgaacggcggatgcccaagcagcgcaaggggcgaatgtgtacatgtatcggtttgattatgaaacgccggcgtttggtggacaactgaaagcgtgccatacgctcgagttgccgtttgtgtttcataacctccatcagcctggtgtcgagaatttcgtcggcaaccgaccagagcgtgaggcgattgccagcgaaatgcatggtgcctggctttcgttcgcccacaccggcaacccgaacggcgctcatttaccagagaagtggcccgtatacacaaaagagcacaaaccggtgtttgtcttttcggctgcgagccatgtggaagacgatccgttcggtcgcgagcgggaagcgtggcaaggacgcctttctagacatcaccatcaccatcactgaatcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 176 - DNA, 37 bp, Artificial Sequence
  Nsp7120rbcprom-F1
tttagacctgcaggctccagccattagcgaaactgac

SEQ ID NO: 177 - DNA, 43 bp, Artificial Sequence
  Nsp7120rbcprom-F2
atggaccctgcaggaatgactattggcaactgacaactgactc

SEQ ID NO: 178 - DNA, 35 bp, Artificial Sequence
  Nsp7120rbcprom-R1
gtaagacatatggatccttccaagatgtcactctt

SEQ ID NO: 179 - DNA, 49 bp, Artificial Sequence
  Nsp7120rbcprom-R2
agcgcaggatccttccaaggcacaccacgtaatttgtaacttgtctcac

SEQ ID NO: 180 - DNA, 849 bp, Artificial Sequence
  Nsp7120 rbc Promoter PCR 1
tttagacctgcaggctccagccattagcgaaactgaccaaaggttaatctcagtcttcccttagttgggattttttaaacatatggggattggggattgggaaaaggcagggggcagaggataagtagaggaggcaggggaagtaaagaagaatgactatggactattgaccaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgcaattttttcatcttgcgctgattactctactaaatatccgtcaagtaaattggctcttagctcgtctcctgtcaataaaggaggtcggcaagagtgcagaagcgggaatgtgtgaaaactaacccaattcattaaataccccgaaatataggggaatcatctcatactttccgtaaaccgcgaaggtcgtgaagggataaaagcaatttagtgggtgagaagaacagataaaaaagaattttttaactatggcaagaggaaaaagtaaaagcgttaacttatgcactcctagatgagcaagacactggtgaagaggattaccactaaagctaagtgttagttgcagaaaggtcgctgacctctaccaaaagattattcctgtttttctcctggctgatagggaggtagggcaattgtgagaggaaattgtaccaaaacgtgatttgataagtaaaaagagtgacatcttggaaggatccatatgtcttacg

SEQ ID NO: 181 - DNA, 690 bp, Artificial Sequence
  Nsp7120 rbc Promoter PCR 2
atggaccctgcaggaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgcaattttttcatcttgcgctgattactctactaaatatccgtcaagtaaattggctcttagctcgtctcctgtcaataaaggaggtcggcaagagtgcagaagcgggaatgtgtgaaaactaacccaattcattaaataccccgaaatataggggaatcatctcatactttccgtaaaccgcgaaggtcgtgaagggataaaagcaatttagtgggtgagaagaacagataaaaaagaattttttaactatggcaagaggaaaaagtaaaagcgttaacttatgcactcctagatgagcaagacactggtgaagaggattaccactaaagctaagtgttagttgcagaaaggtcgctgacctctaccaaaagattattcctgtttttctcctggctgatagggaggtagggcaattgtgagaggaaattgtaccaaaacgtgatttgataagtaaaaagagtgacatcttggaaggatccatatgtcttac

SEQ ID NO: 182 - DNA, 377 bp, Artificial Sequence
  Nsp7120 rbc Promoter PCR 3
tttagacctgcaggctccagccattagcgaaactgaccaaaggttaatctcagtcttcccttagttgggattttttaaacatatggggattggggattgggaaaaggcagggggcagaggataagtagaggaggcaggggaagtaaagaagaatgactatggactattgaccaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgccttggaaggatcctgcgct

SEQ ID NO: 183 - DNA, 219 bp, Artificial Sequence
  Nsp7120 rbc Promoter PCR 4
atggaccctgcaggaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgccttggaaggatcctgcgct

SEQ ID NO: 184 - DNA, 10772 bp, Artificial Sequence
  pLybAL69
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggctccagccattagcgaaactgaccaaaggttaatctcagtcttcccttagttgggattttttaaacatatggggattggggattgggaaaaggcagggggcagaggataagtagaggaggcaggggaagtaaagaagaatgactatggactattgaccaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgcaattttttcatcttgcgctgattactctactaaatatccgtcaagtaaattggctcttagctcgtctcctgtcaataaaggaggtcggcaagagtgcagaagcgggaatgtgtgaaaactaacccaattcattaaataccccgaaatataggggaatcatctcatactttccgtaaaccgcgaaggtcgtgaagggataaaagcaatttagtgggtgagaagaacagataaaaaagaattttttaactatggcaagaggaaaaagtaaaagcgttaacttatgcactcctagatgagcaagacactggtgaagaggattaccactaaagctaagtgttagttgcagaaaggtcgctgacctctaccaaaagattattcctgtttttctcctggctgatagggaggtagggcaattgtgagaggaaattgtaccaaaacgtgatttgataagtaaaaagagtgacatcttggaaggatccatatgatcgtggaaacaaagtacggtcggttgcgcgggggaacaaatgaaggggttttctattggaaagggattccgtacgcgaaagcgccggtcggtgaacgccgttttttgccgccggaaccgcccgatgcatgggacggagtgcgtgaggcgacatcgtttggaccggtcgtcatgcagccgtccgattcgatgttcagccagctgctcggacggatgaatgaaccaatgagcgaggatgggttgtatctgaacatttggtcaccggcggcggatgggaagaagcgcccggtattgttttggattcatggcggcgcttttttattcggctccggttcatttccatggtatgatggaacggcgtttgccaaacacggcgatgtcgttgtcgtgacgatcaactaccggatgagcgtgtttggctttttgtatttgggagatgcgtttggcgaaacgtatgcccaggcgggaaatcttggcatattggatcaagtggcggcgctgcgctgggtgaaagagaacattgaggcgttcggcggtgatccggacaacattacgatttttggcgaatcagccggagcggcaagcgttggcgtgctgttgtcgcttccggaagcaagcgggctgtttcgacgcgctatattgcaaagcggatcgggttcgcttcttcttcgttctccggagacggcgatggctctgactgaacgcattttagaacgtgccggcatccgtccgggtgaccgcgatcggctgctgtcgattccagcagcagagctattgcaggcggcgatgtcgctcggcccaggaatcacgtacggtccggtggttgacggacatgtgttgcgacgccatccgatcgaagcgctccacgacggggcagcaagtgatattccaatcctaattggcgtgacgaaagacgaatacaatttgttttcattgactgatccgtcattgacaagactcgaagaaaaagaactgcttgaccggatgaaccgtgaggtcgggcctattccggaggaggcggtacgctattacgcggaaacagcggatcggtcggcacccgcgtggcaaacatggctgcgcatcatgacgtaccttgtttttgtcgacggaatgttgcgaacggcggatgcccaagcagcgcaaggggcgaatgtgtacatgtatcggtttgattatgaaacgccggcgtttggtggacaactgaaagcgtgccatacgctcgagttgccgtttgtgtttcataacctccatcagcctggtgtcgagaatttcgtcggcaaccgaccagagcgtgaggcgattgccagcgaaatgcatggtgcctggctttcgttcgcccacaccggcaacccgaacggcgctcatttaccagagaagtggcccgtatacacaaaagagcacaaaccggtgtttgtcttttcggctgcgagccatgtggaagacgatccgttcggtcgcgagcgggaagcgtggcaaggacgcctttctagacatcaccatcaccatcactgaatcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 185 - DNA, 10614 bp, Artificial Sequence
  pLybAL70
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgcaattttttcatcttgcgctgattactctactaaatatccgtcaagtaaattggctcttagctcgtctcctgtcaataaaggaggtcggcaagagtgcagaagcgggaatgtgtgaaaactaacccaattcattaaataccccgaaatataggggaatcatctcatactttccgtaaaccgcgaaggtcgtgaagggataaaagcaatttagtgggtgagaagaacagataaaaaagaattttttaactatggcaagaggaaaaagtaaaagcgttaacttatgcactcctagatgagcaagacactggtgaagaggattaccactaaagctaagtgttagttgcagaaaggtcgctgacctctaccaaaagattattcctgtttttctcctggctgatagggaggtagggcaattgtgagaggaaattgtaccaaaacgtgatttgataagtaaaaagagtgacatcttggaaggatccatatgatcgtggaaacaaagtacggtcggttgcgcgggggaacaaatgaaggggttttctattggaaagggattccgtacgcgaaagcgccggtcggtgaacgccgttttttgccgccggaaccgcccgatgcatgggacggagtgcgtgaggcgacatcgtttggaccggtcgtcatgcagccgtccgattcgatgttcagccagctgctcggacggatgaatgaaccaatgagcgaggatgggttgtatctgaacatttggtcaccggcggcggatgggaagaagcgcccggtattgttttggattcatggcggcgcttttttattcggctccggttcatttccatggtatgatggaacggcgtttgccaaacacggcgatgtcgttgtcgtgacgatcaactaccggatgagcgtgtttggctttttgtatttgggagatgcgtttggcgaaacgtatgcccaggcgggaaatcttggcatattggatcaagtggcggcgctgcgctgggtgaaagagaacattgaggcgttcggcggtgatccggacaacattacgatttttggcgaatcagccggagcggcaagcgttggcgtgctgttgtcgcttccggaagcaagcgggctgtttcgacgcgctatattgcaaagcggatcgggttcgcttcttcttcgttctccggagacggcgatggctctgactgaacgcattttagaacgtgccggcatccgtccgggtgaccgcgatcggctgctgtcgattccagcagcagagctattgcaggcggcgatgtcgctcggcccaggaatcacgtacggtccggtggttgacggacatgtgttgcgacgccatccgatcgaagcgctccacgacggggcagcaagtgatattccaatcctaattggcgtgacgaaagacgaatacaatttgttttcattgactgatccgtcattgacaagactcgaagaaaaagaactgcttgaccggatgaaccgtgaggtcgggcctattccggaggaggcggtacgctattacgcggaaacagcggatcggtcggcacccgcgtggcaaacatggctgcgcatcatgacgtaccttgtttttgtcgacggaatgttgcgaacggcggatgcccaagcagcgcaaggggcgaatgtgtacatgtatcggtttgattatgaaacgccggcgtttggtggacaactgaaagcgtgccatacgctcgagttgccgtttgtgtttcataacctccatcagcctggtgtcgagaatttcgtcggcaaccgaccagagcgtgaggcgattgccagcgaaatgcatggtgcctggctttcgttcgcccacaccggcaacccgaacggcgctcatttaccagagaagtggcccgtatacacaaaagagcacaaaccggtgtttgtcttttcggctgcgagccatgtggaagacgatccgttcggtcgcgagcgggaagcgtggcaaggacgcctttctagacatcaccatcaccatcactgaatcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 186 - DNA, 10306 bp, Artificial Sequence
  pLybAL71
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggctccagccattagcgaaactgaccaaaggttaatctcagtcttcccttagttgggattttttaaacatatggggattggggattgggaaaaggcagggggcagaggataagtagaggaggcaggggaagtaaagaagaatgactatggactattgaccaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgccttggaaggatccatatgatcgtggaaacaaagtacggtcggttgcgcgggggaacaaatgaaggggttttctattggaaagggattccgtacgcgaaagcgccggtcggtgaacgccgttttttgccgccggaaccgcccgatgcatgggacggagtgcgtgaggcgacatcgtttggaccggtcgtcatgcagccgtccgattcgatgttcagccagctgctcggacggatgaatgaaccaatgagcgaggatgggttgtatctgaacatttggtcaccggcggcggatgggaagaagcgcccggtattgttttggattcatggcggcgcttttttattcggctccggttcatttccatggtatgatggaacggcgtttgccaaacacggcgatgtcgttgtcgtgacgatcaactaccggatgagcgtgtttggctttttgtatttgggagatgcgtttggcgaaacgtatgcccaggcgggaaatcttggcatattggatcaagtggcggcgctgcgctgggtgaaagagaacattgaggcgttcggcggtgatccggacaacattacgatttttggcgaatcagccggagcggcaagcgttggcgtgctgttgtcgcttccggaagcaagcgggctgtttcgacgcgctatattgcaaagcggatcgggttcgcttcttcttcgttctccggagacggcgatggctctgactgaacgcattttagaacgtgccggcatccgtccgggtgaccgcgatcggctgctgtcgattccagcagcagagctattgcaggcggcgatgtcgctcggcccaggaatcacgtacggtccggtggttgacggacatgtgttgcgacgccatccgatcgaagcgctccacgacggggcagcaagtgatattccaatcctaattggcgtgacgaaagacgaatacaatttgttttcattgactgatccgtcattgacaagactcgaagaaaaagaactgcttgaccggatgaaccgtgaggtcgggcctattccggaggaggcggtacgctattacgcggaaacagcggatcggtcggcacccgcgtggcaaacatggctgcgcatcatgacgtaccttgtttttgtcgacggaatgttgcgaacggcggatgcccaagcagcgcaaggggcgaatgtgtacatgtatcggtttgattatgaaacgccggcgtttggtggacaactgaaagcgtgccatacgctcgagttgccgtttgtgtttcataacctccatcagcctggtgtcgagaatttcgtcggcaaccgaccagagcgtgaggcgattgccagcgaaatgcatggtgcctggctttcgttcgcccacaccggcaacccgaacggcgctcatttaccagagaagtggcccgtatacacaaaagagcacaaaccggtgtttgtcttttcggctgcgagccatgtggaagacgatccgttcggtcgcgagcgggaagcgtggcaaggacgcctttctagacatcaccatcaccatcactgaatcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 187 - DNA, 10148 bp, Artificial Sequence
  pLybAL72
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgccttggaaggatccatatgatcgtggaaacaaagtacggtcggttgcgcgggggaacaaatgaaggggttttctattggaaagggattccgtacgcgaaagcgccggtcggtgaacgccgttttttgccgccggaaccgcccgatgcatgggacggagtgcgtgaggcgacatcgtttggaccggtcgtcatgcagccgtccgattcgatgttcagccagctgctcggacggatgaatgaaccaatgagcgaggatgggttgtatctgaacatttggtcaccggcggcggatgggaagaagcgcccggtattgttttggattcatggcggcgcttttttattcggctccggttcatttccatggtatgatggaacggcgtttgccaaacacggcgatgtcgttgtcgtgacgatcaactaccggatgagcgtgtttggctttttgtatttgggagatgcgtttggcgaaacgtatgcccaggcgggaaatcttggcatattggatcaagtggcggcgctgcgctgggtgaaagagaacattgaggcgttcggcggtgatccggacaacattacgatttttggcgaatcagccggagcggcaagcgttggcgtgctgttgtcgcttccggaagcaagcgggctgtttcgacgcgctatattgcaaagcggatcgggttcgcttcttcttcgttctccggagacggcgatggctctgactgaacgcattttagaacgtgccggcatccgtccgggtgaccgcgatcggctgctgtcgattccagcagcagagctattgcaggcggcgatgtcgctcggcccaggaatcacgtacggtccggtggttgacggacatgtgttgcgacgccatccgatcgaagcgctccacgacggggcagcaagtgatattccaatcctaattggcgtgacgaaagacgaatacaatttgttttcattgactgatccgtcattgacaagactcgaagaaaaagaactgcttgaccggatgaaccgtgaggtcgggcctattccggaggaggcggtacgctattacgcggaaacagcggatcggtcggcacccgcgtggcaaacatggctgcgcatcatgacgtaccttgtttttgtcgacggaatgttgcgaacggcggatgcccaagcagcgcaaggggcgaatgtgtacatgtatcggtttgattatgaaacgccggcgtttggtggacaactgaaagcgtgccatacgctcgagttgccgtttgtgtttcataacctccatcagcctggtgtcgagaatttcgtcggcaaccgaccagagcgtgaggcgattgccagcgaaatgcatggtgcctggctttcgttcgcccacaccggcaacccgaacggcgctcatttaccagagaagtggcccgtatacacaaaagagcacaaaccggtgtttgtcttttcggctgcgagccatgtggaagacgatccgttcggtcgcgagcgggaagcgtggcaaggacgcctttctagacatcaccatcaccatcactgaatcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 188 - DNA, 11411 bp, Artificial Sequence
  pLybDB2
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggctccagccattagcgaaactgaccaaaggttaatctcagtcttcccttagttgggattttttaaacatatggggattggggattgggaaaaggcagggggcagaggataagtagaggaggcaggggaagtaaagaagaatgactatggactattgaccaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgcaattttttcatcttgcgctgattactctactaaatatccgtcaagtaaattggctcttagctcgtctcctgtcaataaaggaggtcggcaagagtgcagaagcgggaatgtgtgaaaactaacccaattcattaaataccccgaaatataggggaatcatctcatactttccgtaaaccgcgaaggtcgtgaagggataaaagcaatttagtgggtgagaagaacagataaaaaagaattttttaactatggcaagaggaaaaagtaaaagcgttaacttatgcactcctagatgagcaagacactggtgaagaggattaccactaaagctaagtgttagttgcagaaaggtcgctgacctctaccaaaagattattcctgtttttctcctggctgatagggaggtagggcaattgtgagaggaaattgtaccaaaacgtgatttgataagtaaaaagagtgacatcttggaaggatccatatggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttctagccatcaccatcaccatcattaaatcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 189 - DNA, 11253 bp, Artificial Sequence
  pLybDB3
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgcaattttttcatcttgcgctgattactctactaaatatccgtcaagtaaattggctcttagctcgtctcctgtcaataaaggaggtcggcaagagtgcagaagcgggaatgtgtgaaaactaacccaattcattaaataccccgaaatataggggaatcatctcatactttccgtaaaccgcgaaggtcgtgaagggataaaagcaatttagtgggtgagaagaacagataaaaaagaattttttaactatggcaagaggaaaaagtaaaagcgttaacttatgcactcctagatgagcaagacactggtgaagaggattaccactaaagctaagtgttagttgcagaaaggtcgctgacctctaccaaaagattattcctgtttttctcctggctgatagggaggtagggcaattgtgagaggaaattgtaccaaaacgtgatttgataagtaaaaagagtgacatcttggaaggatccatatggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttctagccatcaccatcaccatcattaaatcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 190 - DNA, 10945 bp, Artificial Sequence
  pLybDB4
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggctccagccattagcgaaactgaccaaaggttaatctcagtcttcccttagttgggattttttaaacatatggggattggggattgggaaaaggcagggggcagaggataagtagaggaggcaggggaagtaaagaagaatgactatggactattgaccaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgccttggaaggatccatatggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttctagccatcaccatcaccatcattaaatcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 191 - DNA, 10787 bp, Artificial Sequence
  pLybDB5
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgccttggaaggatccatatggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttctagccatcaccatcaccatcattaaatcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 192 - DNA, 1993 bp, Artificial Sequence
  pSMARTGC LK
gtcgtcgacgaattctctagatatcgctcaatactgaccatttaaatcatacctgacctccatagcagaaagtcaaaagcctccgaccggaggcttttgacttgatcggcacgtaagaggttccaactttcaccataatgaaataagatcactaccgggcgtattttttgagttatcgagattttcaggagctaaggaagctaaaatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcaggctaaactggctgacggaatttatgcctcttccgaccatcaagcattttatccgtactcctgatgatgcatggttactcaccactgcgatcccagggaaaacagcattccaggtattagaagaatatcctgattcaggtgaaaatattgttgatgcgctggcagtgttcctgcgccggttgcattcgattcctgtttgtaattgtccttttaacggcgatcgcgtatttcgtctcgctcaggcgcaatcacgaatgaataacggtttggttggtgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcacttgatgctcgatgagtttttctaataagaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgatgagggcccaaatgtaatcacctggctcaccttcgggtgggcctttctgcgttgctggcgtttttccataggctccgcccccctgacgagcatcacaaaaatcgatgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttacctcggaaaaagagttggtagctcttgatccggcaaacaaaccaccgctggtagcggtggtttttttgtttgcaagcagcagattacgcgcagaaaaaaaggatctcaagaagatcctttgattttctaccgaagaaaggcccacccgtgaaggtgagccagtgagttgattgcagtccagttacgctggagtctgaggctcgtcctgaatgatatcaagcttgaattcgtcgacgac

SEQ ID NO: 193 - DNA, 25 bp, Artificial Sequence
  Sspuppins-F
tttcccatggcttctcaattacgtg

SEQ ID NO: 194 - DNA, 29 bp, Artificial Sequence
  Sspuppins-R
ctttttgagccatgactttactcctgttg

SEQ ID NO: 195 - DNA, 2732 bp, Artificial Sequence
  pLybAL73f
gctcgtcgacgaattctctagatatcgctcaatactgaccatttaaatcatacctgacctccatagcagaaagtcaaaagcctccgaccggaggcttttgacttgatcggcacgtaagaggttccaactttcaccataatgaaataagatcactaccgggcgtattttttgagttatcgagattttcaggagctaaggaagctaaaatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcaggctaaactggctgacggaatttatgcctcttccgaccatcaagcattttatccgtactcctgatgatgcatggttactcaccactgcgatcccagggaaaacagcattccaggtattagaagaatatcctgattcaggtgaaaatattgttgatgcgctggcagtgttcctgcgccggttgcattcgattcctgtttgtaattgtccttttaacggcgatcgcgtatttcgtctcgctcaggcgcaatcacgaatgaataacggtttggttggtgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcacttgatgctcgatgagtttttctaataagaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgatgagggcccaaatgtaatcacctggctcaccttcgggtgggcctttctgcgttgctggcgtttttccataggctccgcccccctgacgagcatcacaaaaatcgatgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttacctcggaaaaagagttggtagctcttgatccggcaaacaaaccaccgctggtagcggtggtttttttgtttgcaagcagcagattacgcgcagaaaaaaaggatctcaagaagatcctttgattttctaccgaagaaaggcccacccgtgaaggtgagccagtgagttgattgcagtccagttacgctggagtctgaggctcgtcctgaatgatatcaagcttgaattcgtcgacgactttcccatggcttctcaattacgtgtttatgtgccggagcatcctctaattaagcattggttgggggtagctagggatgaaaacacgccgccggttttgtttaaaactgccatgggggaattgggacgttggttgacctatgaggccgctcgttattggttgccgacggtggatacggaagtgaaaactcccctggcgatcgccaaggccagtcttattgacccccaaacgccctttgtcattgtgcccattttgcgggcggggttggctctggtggaaggggcccaggggttgttgcccctggcaaaaatttaccatctgggtttagtgcgcaatgaaactaccctggaacctagtctgtatctgaacaagttgccggagcggtttgcccccggtacccatcttttgttgctagatcccatgttggctacgggtaataccatcatggctgctttggatttgctgatggcccgggacattgatgccaatttaatccgtttggtctccgtggtggccgcccccactgccctgcaaaaattaagtaatgcccatcccaatttgaccatctacaccgccatgattgacgaacaactcaatgaccggggttacattgtgcccggcctaggggatgcaggcgatcgttgctttggtacttgataacaccattaaactagtgatcaaataattacaaattcacccccaaacgttaacaacaggagtaaagtcatggctcaaaaa

SEQ ID NO: 196 - DNA, 45 bp, Artificial Sequence
  SspuppMCS-F
gcaatgaagcatgcctgcaggtcgacggcgccgcggccgcggtac

SEQ ID NO: 197 - DNA, 41 bp, Artificial Sequence
  SspuppMCS-R
cgcggccgcggcgccgtcgacctgcaggcatgcttcattgc

SEQ ID NO: 198 - DNA, 2714 bp, Artificial Sequence
  pLybAL74f
gatgtcgtcgacgaattctctagatatcgctcaatactgaccatttaaatcatacctgacctccatagcagaaagtcaaaagcctccgaccggaggcttttgacttgatcggcacgtaagaggttccaactttcaccataatgaaataagatcactaccgggcgtattttttgagttatcgagattttcaggagctaaggaagctaaaatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcaggctaaactggctgacggaatttatgcctcttccgaccatcaagcattttatccgtactcctgatgatgcatggttactcaccactgcgatcccagggaaaacagcattccaggtattagaagaatatcctgattcaggtgaaaatattgttgatgcgctggcagtgttcctgcgccggttgcattcgattcctgtttgtaattgtccttttaacggcgatcgcgtatttcgtctcgctcaggcgcaatcacgaatgaataacggtttggttggtgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcacttgatgctcgatgagtttttctaataagaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgatgagggcccaaatgtaatcacctggctcaccttcgggtgggcctttctgcgttgctggcgtttttccataggctccgcccccctgacgagcatcacaaaaatcgatgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttacctcggaaaaagagttggtagctcttgatccggcaaacaaaccaccgctggtagcggtggtttttttgtttgcaagcagcagattacgcgcagaaaaaaaggatctcaagaagatcctttgattttctaccgaagaaaggcccacccgtgaaggtgagccagtgagttgattgcagtccagttacgctggagtctgaggctcgtcctgaatgatatcaagcttgaattcgttgacgacgttttcccatggcttctcaattacgtgtttatgtgccggagcatcctctaattaagcattggttgggggtagctagggatgaaaacacgccgccggttttgtttaaaactgccatgggggaattgggacgttggttgacctatgaggccgctcgttattggttgccgacggtggatacggaagtgaaaactcccctggcgatcgccaaggccagtcttattgacccccaaacgccctttgtcattgtgcccattttgcgggcggggttggctctggtggaaggggcccaggggttgttgcccctggcaaaaatttaccatctgggtttagtgcgcaatgaagcatgcctgcaggtcgacggcgccgcggccgcggtacccatcttttgttgctagatcccatgttggctacgggtaataccatcatggctgctttggatttgctgatggcccgggacattgatgccaatttaatccgtttggtctccgtggtggccgcccccactgccctgcaaaaattaagtaatgcccatcccaatttgaccatctacaccgccatgattgacgaacaactcaatgaccggggttacattgtgcccggcctaggggatgcaggcgatcgttgctttggtacttgataacaccattaaactagtgatcaaataattacaaattcacccccaaacgttaacaacaggagtaaagtcatggctcaaaaa

SEQ ID NO: 199 - DNA, 36 bp, Artificial Sequence
  Selo7942rbcTerm-F
gcagctcctgcctttgggcaggggcttttttgcatg

SEQ ID NO: 200 - DNA, 32 bp, Artificial Sequence
  Selo7942rbcTerm-R
caaaaaagcccctgcccaaaggcaggagctgc

SEQ ID NO: 201 - DNA, 2733 bp, Artificial Sequence
  pLybAL75f
ctaccgaagaaaggcccacccgtgaaggtgagccagtgagttgattgcagtccagttacgctggagtctgaggctcgtcctgaatgatatcaagcttgaattcgtcgacgactttcccatggcttctcaattacgtgtttatgtgccggagcatcctctaattaagcattggttgggggtagctagggatgaaaacacgccgccggttttgtttaaaactgccatgggggaattgggacgttggttgacctatgaggccgctcgttattggttgccgacggtggatacggaagtgaaaactcccctggcgatcgccaaggccagtcttattgacccccaaacgccctttgtcattgtgcccattttgcgggcggggttggctctggtggaaggggcccaggggttgttgcccctggcaaaaatttaccatctgggtttagtgcgcagctcctgcctttgggcaggggcttttttgcatgcctgcaggtcgacggcgccgcggccgcggtacccatcttttgttgctagatcccatgttggctacgggtaataccatcatggctgctttggatttgctgatggcccgggacattgatgccaatttaatccgtttggtctccgtggtggccgcccccactgccctgcaaaaattaagtaatgcccatcccaatttgaccatctacaccgccatgattgacgaacaactcaatgaccggggttacattgtgcccggcctaggggatgcaggcgatcgttgctttggtacttgataacaccattaaactagtgatcaaataattacaaattcacccccaaacgttaacaacaggagtaaagtcatggctcaaaaagctcgtcgacgaattctctagatatcgctcaatactgaccatttaaatcatacctgacctccatagcagaaagtcaaaagcctccgaccggaggcttttgacttgatcggcacgtaagaggttccaactttcaccataatgaaataagatcactaccgggcgtattttttgagttatcgagattttcaggagctaaggaagctaaaatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcaggctaaactggctgacggaatttatgcctcttccgaccatcaagcattttatccgtactcctgatgatgcatggttactcaccactgcgatcccagggaaaacagcattccaggtattagaagaatatcctgattcaggtgaaaatattgttgatgcgctggcagtgttcctgcgccggttgcattcgattcctgtttgtaattgtccttttaacggcgatcgcgtatttcgtctcgctcaggcgcaatcacgaatgaataacggtttggttggtgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcacttgatgctcgatgagtttttctaataagaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgatgagggcccaaatgtaatcacctggctcaccttcgggtgggcctttctgcgttgctggcgtttttccataggctccgcccccctgacgagcatcacaaaaatcgatgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttacctcggaaaaagagttggtagctcttgatccggcaaacaaaccaccgctggtagcggtggtttttttgtttgcaagcagcagattacgcgcagaaaaaaaggatctcaagaagatcctttgatttt

SEQ ID NO: 202 - DNA, 7618 bp, Artificial Sequence
  pLG338
aattctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgcatgcttttctgctggaatttggcattagcgttccccgaggagctgccgttattagccgactgagtaccattcttgaggataatagtttgcctctttacctcagccagttattgctgaaattacaacagcattatcactatcttgttgagcagattaaagatttggaatcccagttgaaacgaaagttggacgaagatgaggttggacagcgcttgctgagcattccctgcgtcggaacactgacagcgagtactatttcaactgagattggcgacgggaagcagtacgccagcagccgtgactttgcggcggcaacagggcttgtacctcggcagtacagcacgggaggtaggacgacattgctgggaattagtaagcgaggtaataaaaagatccgaactttgttggttcaatgtgccagggtattcatacaaaaactggaacaccagtctggcaaattggccgattgggtcagggatttactgtgccggaaaagcaactttgtcgtcacttgtgctctggcaaacaagctggccagaatagcctgggccctaacggcacgacagcaaacttatgtagcataacggcagaaatacaccggtttaaagaattactgatctggttttgcgaatactgatattgatgatactaacggcccaccggcctgttgaggaacctgtaaaacggaaaggctcattgaagccgtatattttctggaggttcatcaggcgcggaactcatcaaggcgcgggaataaaatcccattcagacgccggatagattcaagcaagccaacttgtcgtcaaaatcggtgttgcaaaaacgggagtgaccatagattccgttttctgagacgacccctattatggcgaaggtatcattcaggaagcgttgatgaaggattatctctgtaaaaagttattcaaccggctttccggtaccctggtgatcagagcgcgctgcggcaataacattactggcctggcatgttgcaatattctttatccctcgccccgatacagcggtcagctgcatattaaagagctgtatgtttctcagtgcgatcgaaataagggcacgggtaaagcgataatgcgctttatagcccggcttgcgcttgaacaggaatgccttagccttagctggaacgctgaaaaatccaaccccggcgctaaccgtttttatcaggctctgggaggcagaataaatgatcatatcgtcaattattacctccacggggagagcctgagcaaactggcctcaggcatttgagaagcacacggtcacactgcttccggtagtcaataaaccggtaaaccagcaatagacataagcggctatttaacgaccctgccctgaaccgacgaccgggtcgaatttgctttcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaaatgatcatatcgtcaattattacctccacggggagagcctgagcaaactggcctcaggcatttgagaagcacacggtcacactgcttccggtagtcaataaaccggtaaaccagcaatag

SEQ ID NO: 203 - DNA, 5392 bp, Artificial Sequence
  pLybAL78A
atcgtccattccgacagcatcgccagtcactatggcgtgctgctagcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatg

SEQ ID NO: 204 - DNA, 5685 bp, Artificial Sequence
  pLybAL79
atcgtccattccgacagcatcgccagtcactatggcgtgctgctagagaattcgtcgacgagctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatgggtaccgcggccgcggcgccgtcgacctgcaggcatgcaaaaaagcccctgcccaaaggcaggagctgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaagtcgtcgacgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatg

SEQ ID NO: 205 - DNA, 8497 bp, Artificial Sequence
  pLybAL80
atcgtccattccgacagcatcgccagtcactatggcgtgctgctagagaattcgtcgacgagctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatgggtaccgcggcccgatttaatgatggtgatggtgatggctagaagcgatcgcctcaaaaaagcgatagtgttttaaggcttccagaatgccattagcatagtggccctcagcaaaatagacgcgctcgtagctgcgcagtggctccaattccggtgagtaattgccaactacaacgccgagattatggcccttgagcatttcctcatcgttaccagaatcgcctgccaccaaaatgttctcaagaggaatccgccagcggagtgagaggtggcgaatcgcatcccctttcgaggcagctagcggcagaatgtcaagaaactcctgatgggaatagattgacttcagccgcaggcgatggcggcgaagatgttgccgtacttctcgcagcacagtctcgtggcgatcgcggacaaagaagctgactttgaagggtgtttgatcctcttccggctgcagttcaagaaagggtagttgtgccattactgcccgaattcgctgaggattccagttgcgattgatatgcttttcccagctgatatccggttcagcatcggtgccatagtgaatctcgctgccgacggaagtcacccagaagtttggcgaaggaacgccccactctttcaagacttcttgggcagagtctaggcgacgccccgtggcaattccaaaggcaaaatgatcgcgatactgatcgagataggtcattaaattctcgagtccttgacgatcgcccaacagtgtgttgtcgatgtcactaacgacaaggcgtttggcatcaatcaagcgtttgcgactccgtacgaaactgacagcacgacgacgaggcaaagccaccgtttccatgcgctcaaacagggtattgacatgttgatcccagctgtaatgggcgggaactttttcaatgccattgcggtgatagcactgccaaagatcgcgatcgctcagcagggtggcgagtgcagtcgcgatattagcgggtcggctgacatcaactaaagtgccgaaatcacagtgtttgagaatttcctgggggccgccatcatgggttgccaccaccggcacgccgcagcttcctgcctccaaaattgtcaaaccaaaaggttcggtcagcgccggattgacgaataccccgccggaatgagccgctaggcgatagaactccggcacatcatcagcctgatgctgtttgggataggcgacgctgccgtagaggtcgtagcgatcgaccagatggaaaatctcttggaacacctgccgactgccgcgatccatctggttgatgtcttggcggctgcccagtactaagacaaggttggcttttttgcgcagccaaggatgttcgccaaaggctcgcaccagcgccggtacatttttgcgaggtgcggggcgacagaggcagagaatttgaggtttttctgggtcgcgcagaaagcggctcagttcctgttggagaacaacaccgcgatcgcccaagggctgaaacctgaagcgatcggtatcgacacccggtggaatgacaagcttgcgctctgggttgtagcgatcgtaaacgcggtattgctcctccacttcctgctgagtgctggcgacaatccagtcagcatgagtgagcgtcatctcctccgcatcaattcgctgttgaatattgaattgcgcttcaatttcctcaagcggccagtcttgctccaacagcttttttagcttgatccgccccagagaatgccctgtgaaaattagcggtacattcaaccagcgactcagcagtgatcccacttggccagcatcagcatagtgggcctgaatccaagtcggggtgcgcttttgctgagccagatattggagaattgcatccgcaaaggtgtagagatggggccaaagcagctctttacggaggtagcgtttggggccaaaaggcaaacggacaatccgacctttgggcgcaaagggttcgatcgcctgactgtaaccaacactgacgcgggggtcggtgatttggcgggtgatgatgtcgacttgttggacttgtggggatttagcttgggcttgagccagttctaagacgtacttggtctgcccgccggtgtcggcatctcgccccagttccaagttctgccctcgcagcagaccatgggtctgaatgtgcagaatgtagagattttgagctgccatatggatccttccaagatgtcactctttttacttatcaaatcacgttttggtacaatttcctctcacaattgccctacctccctatcagccaggagaaaaacaggaataatcttttggtagaggtcagcgacctttctgcaactaacacttagctttagtggtaatcctcttcaccagtgtcttgctcatctaggagtgcataagttaacgcttttactttttcctcttgccatagttaaaaaattcttttttatctgttcttctcacccactaaattgcttttatcccttcacgaccttcgcggtttacggaaagtatgagatgattcccctatatttcggggtatttaatgaattgggttagttttcacacattcccgcttctgcactcttgccgacctcctttattgacaggagacgagctaagagccaatttacttgacggatatttagtagagtaatcagcgcaagatgaaaaaattgcacaccacgtaatttgtaacttgtctcacaatatatcaagaaatggcataagttattctttgaaagttcttaacttacatatttaaatttgttattacataaagttttaaacgttttgttaacaatcagttacaaaatgtatcaatgactgtataggagtcagttgtcagttgccaatagtcattcctgcaggcatgcaaaaaagcccctgcccaaaggcaggagctgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaagtcgtcgacgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatg

SEQ ID NO: 206 - DNA, 8189 bp, Artificial Sequence
  pLybAL81
atcgtccattccgacagcatcgccagtcactatggcgtgctgctagagaattcgtcgacgagctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatgggtaccgcggcccgatttaatgatggtgatggtgatggctagaagcgatcgcctcaaaaaagcgatagtgttttaaggcttccagaatgccattagcatagtggccctcagcaaaatagacgcgctcgtagctgcgcagtggctccaattccggtgagtaattgccaactacaacgccgagattatggcccttgagcatttcctcatcgttaccagaatcgcctgccaccaaaatgttctcaagaggaatccgccagcggagtgagaggtggcgaatcgcatcccctttcgaggcagctagcggcagaatgtcaagaaactcctgatgggaatagattgacttcagccgcaggcgatggcggcgaagatgttgccgtacttctcgcagcacagtctcgtggcgatcgcggacaaagaagctgactttgaagggtgtttgatcctcttccggctgcagttcaagaaagggtagttgtgccattactgcccgaattcgctgaggattccagttgcgattgatatgcttttcccagctgatatccggttcagcatcggtgccatagtgaatctcgctgccgacggaagtcacccagaagtttggcgaaggaacgccccactctttcaagacttcttgggcagagtctaggcgacgccccgtggcaattccaaaggcaaaatgatcgcgatactgatcgagataggtcattaaattctcgagtccttgacgatcgcccaacagtgtgttgtcgatgtcactaacgacaaggcgtttggcatcaatcaagcgtttgcgactccgtacgaaactgacagcacgacgacgaggcaaagccaccgtttccatgcgctcaaacagggtattgacatgttgatcccagctgtaatgggcgggaactttttcaatgccattgcggtgatagcactgccaaagatcgcgatcgctcagcagggtggcgagtgcagtcgcgatattagcgggtcggctgacatcaactaaagtgccgaaatcacagtgtttgagaatttcctgggggccgccatcatgggttgccaccaccggcacgccgcagcttcctgcctccaaaattgtcaaaccaaaaggttcggtcagcgccggattgacgaataccccgccggaatgagccgctaggcgatagaactccggcacatcatcagcctgatgctgtttgggataggcgacgctgccgtagaggtcgtagcgatcgaccagatggaaaatctcttggaacacctgccgactgccgcgatccatctggttgatgtcttggcggctgcccagtactaagacaaggttggcttttttgcgcagccaaggatgttcgccaaaggctcgcaccagcgccggtacatttttgcgaggtgcggggcgacagaggcagagaatttgaggtttttctgggtcgcgcagaaagcggctcagttcctgttggagaacaacaccgcgatcgcccaagggctgaaacctgaagcgatcggtatcgacacccggtggaatgacaagcttgcgctctgggttgtagcgatcgtaaacgcggtattgctcctccacttcctgctgagtgctggcgacaatccagtcagcatgagtgagcgtcatctcctccgcatcaattcgctgttgaatattgaattgcgcttcaatttcctcaagcggccagtcttgctccaacagcttttttagcttgatccgccccagagaatgccctgtgaaaattagcggtacattcaaccagcgactcagcagtgatcccacttggccagcatcagcatagtgggcctgaatccaagtcggggtgcgcttttgctgagccagatattggagaattgcatccgcaaaggtgtagagatggggccaaagcagctctttacggaggtagcgtttggggccaaaaggcaaacggacaatccgacctttgggcgcaaagggttcgatcgcctgactgtaaccaacactgacgcgggggtcggtgatttggcgggtgatgatgtcgacttgttggacttgtggggatttagcttgggcttgagccagttctaagacgtacttggtctgcccgccggtgtcggcatctcgccccagttccaagttctgccctcgcagcagaccatgggtctgaatgtgcagaatgtagagattttgagctgccatatggatccttccaaggcacaccacgtaatttgtaacttgtctcacaatatatcaagaaatggcataagttattctttgaaagttcttaacttacatatttaaatttgttattacataaagttttaaacgttttgttaacaatcagttacaaaatgtatcaatgactgtataggagtcagttgtcagttgccaatagtcattggtcaatagtccatagtcattcttctttacttcccctgcctcctctacttatcctctgccccctgccttttcccaatccccaatccccatatgtttaaaaaatcccaactaagggaagactgagattaacctttggtcagtttcgctaatggctggagcctgcaggcatgcaaaaaagcccctgcccaaaggcaggagctgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaagtcgtcgacgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatg

SEQ ID NO: 207 - DNA, 2202 bp, Artificial Sequence
  Ssp6803 rubisco_Ssp6803 sps/spp Synthetic Construct_2
tctagagaggagtggcaatcgcccataaatcttcttcaattcccgccatggcaacggctcacaagcccaactaatcaccatttggacaaaacatcaggaattctaattagaaagtccaaaaattgtaatttaaaaaacagtcaatggagagcattgccataagtaaaggcatcccctgcgtgataagattaccttcagaaaacagatagttgctgggttatcgcagatttttctcgcaaccaaataactgtaaataataactgtctctggggcgacggtaggctttatattgccaaatttcgcccgtgggagaaagctaggctattcaatgtttatggaggactgacctagatgagctattcatcaaaatacattttactaattagtgtccatggtttaattcggggagaaaaccttgagttgggcagagatgccgacaccggcgggcaaaccaaatatgtgctggaactggcccgggactagtttggaccaaaatttactgggggcattacaggggggattaccgggcgatcgccagacgttggacgaattactggaagtgctgtatcaacatcgaaaaaatgtcggcttttgcattgccactgggagaagattggattcggtgctgaaaattttgcgggagtatcgcattccccaaccggatatgttgatcaccagcatgggcacggaaatttattcttccccggatttgatccccgaccagagttggcgcaatcacattgattatttgtggaaccgtaacgccattgtgcgtattttgggggaattacccggtttagccctccaacccaaggaagaactgagcgcctataaaattagctatttctacgatgcggcgatcgcccctaacctagaagaaattcggcaactgttgcataaaggggaacaaaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttccagtcatcaccatcaccatcattaacgtagtcatcagcaaggaaaacttttaaatcgatgcgacagttattgctaatttctgacctggacaatacctgggtcggagatcaacaagccctggaacatttgcaagaatatctaggcgatcgccggggaaatttttatttggcctatgccacggggcgttcctaccattccgcgagggagttgcaaaaacaggtgggactcatggaaccggactattggctcaccgcggtggggagtgaaatttaccatccagaaggcctggaccaacattgggctgattacctctctgagcattggcaacgggatatcctccaggcgatcgccgatggttttgaggccttaaaaccccaatctcccttggaacaaaacccatggaaaattagctatcatctcgatccccaggcttgccccaccgtcatcgaccaattaacggagatgttgaaggaaaccggcatcccggtgcaggtgattttcagcagtggcaaagatgtggatttattgccccaacggagtaacaaaggtaacgccacccaatatctgcaacaacatttagccatggagccgtctcaaaccctggtgtgtggggactccggcaatgatattggcttatttgaaacttccgctcggggtgtcattgtccgtaatgcccagccggaattattgcactggtatgaccaatggggggattctcgtcattatcgggcccaatcgagccatgctggcgctatcctagaggcgatcgcccatttcgattttttgagctctagccatcatcaccatcaccattaagttacagttttggcaattactaaaaaactgacttcaattcaatgttagcccgctcccgcgggttttttgttgctttttcacagtgactataggtaatcagcaacacaatacggccctgttctttggacagtttttgtataatggcggccgcgtttaaac

SEQ ID NO: 208 - DNA, 25 bp, Artificial Sequence
  Ssp6803spsXS-F
gaaaaccttgagttgggcagagatg

SEQ ID NO: 209 - DNA, 29 bp, Artificial Sequence
  Ssp6803spsXS-R
gatacagcacttccagtaattcgtccaac

SEQ ID NO: 210 - DNA, 10633 bp, Artificial Sequence
  pLybAL66
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggtcgactctagagaggagtggcaatcgcccataaatcttcttcaattcccgccatggcaacggctcacaagcccaactaatcaccatttggacaaaacatcaggaattctaattagaaagtccaaaaattgtaatttaaaaaacagtcaatggagagcattgccataagtaaaggcatcccctgcgtgataagattaccttcagaaaacagatagttgctgggttatcgcagatttttctcgcaaccaaataactgtaaataataactgtctctggggcgacggtaggctttatattgccaaatttcgcccgtgggagaaagctaggctattcaatgtttatggaggactgacctagatgagctattcatcaaaatacattttactaattagtgtccatggtttaattcggggagaaaaccttgagttgggcagagatgccgacaccggcgggcaaaccaaatatgtgctggaactggcccgggactagtttggaccaaaatttactgggggcattacaggggggattaccgggcgatcgccagacgttggacgaattactggaagtgctgtatcaacatcgaaaaaatgtcggcttttgcattgccactgggagaagattggattcggtgctgaaaattttgcgggagtatcgcattccccaaccggatatgttgatcaccagcatgggcacggaaatttattcttccccggatttgatccccgaccagagttggcgcaatcacattgattatttgtggaaccgtaacgccattgtgcgtattttgggggaattacccggtttagccctccaacccaaggaagaactgagcgcctataaaattagctatttctacgatgcggcgatcgcccctaacctagaagaaattcggcaactgttgcataaaggggaacaaaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttccagtcatcaccatcaccatcattaacgtagtcatcagcaaggaaaacttttaaatcgatgcgacagttattgctaatttctgacctggacaatacctgggtcggagatcaacaagccctggaacatttgcaagaatatctaggcgatcgccggggaaatttttatttggcctatgccacggggcgttcctaccattccgcgagggagttgcaaaaacaggtgggactcatggaaccggactattggctcaccgcggtggggagtgaaatttaccatccagaaggcctggaccaacattgggctgattacctctctgagcattggcaacgggatatcctccaggcgatcgccgatggttttgaggccttaaaaccccaatctcccttggaacaaaacccatggaaaattagctatcatctcgatccccaggcttgccccaccgtcatcgaccaattaacggagatgttgaaggaaaccggcatcccggtgcaggtgattttcagcagtggcaaagatgtggatttattgccccaacggagtaacaaaggtaacgccacccaatatctgcaacaacatttagccatggagccgtctcaaaccctggtgtgtggggactccggcaatgatattggcttatttgaaacttccgctcggggtgtcattgtccgtaatgcccagccggaattattgcactggtatgaccaatggggggattctcgtcattatcgggcccaatcgagccatgctggcgctatcctagaggcgatcgcccatttcgattttttgagctctagccatcatcaccatcaccattaagttacagttttggcaattactaaaaaactgacttcaattcaatgttagcccgctcccgcgggttttttgttgctttttcacagtgactataggtaatcagcaacacaatacggccctgttctttggacagtttttgtataatggcggccgcgtttcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 211 - DNA, 1447 bp, Artificial Sequence
  Ssp6803 sps XmaI/SpeI PCR
gaaaaccttgagttgggcagagatgccgacaccggcgggcaaaccaaatatgtgctggaactggcccgggccttggtaaaaaatccccaggtggccagggtggatttgctgacccgtttaattaaagatcccaaagtagatgcagattatgcccagcctagagaacttattggcgatcgggcccagattgttcgcattgagtgcggcccggaggaatatattgccaaggaaatgctctgggactatttggataattttgctgaccatgccctggactatctcaaagaacagcccgaactgcccgatgtcatccatagccattacgccgatgcgggttacgtgggcaccagactttctcaccaattgggtattcctttggtgcacaccggacattccctgggtcgtagtaagcgcacccgtctcctgctcagtgggattaaagccgacgaaattgaaagccgttacaatatggcccgccggattaacgcggaggaagaaaccctaggatcagcggcgagggtgattaccagtacccatcaggaaatcgcagaacagtacgcccaatacgactattaccagccagaccagatgttggttattccccccggcactgatttagaaaagttttatccccccaaagggaacgagtgggaaacgcccattgttcaagagttgcaacgatttctacggcatccccgtaagcctattatcctcgctttgtcccgaccggatccccgcaaaaatatccataaattaattgcagcctatggccagtccccgcagttacaggcccaggccaatttggtcattgtggcgggcaatcgggatgacatcacggatctagaccaggggccgagggaagtactgacggatttactgttgaccattgaccgttacgatctctacggcaaagtggcttaccccaaacagaatcaggcggaggatgtgtatgctttgtttcgcctcactgctttatcccagggagtatttatcaatccggctttgacggaaccctttggtttaactttgattgaagcggcggcctgtggtgtgcccattgtggccacggaggatgggggcccggtggatattatcaaaaattgtcagaatggctatctaattaatcccctcgatgaagtggatattgcggataaattgctcaaagtactaaacgacaaacaacaatggcaattcctttctgaaagtggtctagagggagttaagcgccattattcttggccttcccacgttgaaagttatttagaagccatcaacgctctgacccaacagacttcagtgctgaaacgtagtgatttaaagcggcggcggactttgtactataacggtgccctggttactagtttggaccaaaatttactgggggcattacaggggggattaccgggcgatcgccagacgttggacgaattactggaagtgctgtatc

SEQ ID NO: 212 - DNA, 11919 bp, Artificial Sequence
  pLybAL67
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggtcgactctagagaggagtggcaatcgcccataaatcttcttcaattcccgccatggcaacggctcacaagcccaactaatcaccatttggacaaaacatcaggaattctaattagaaagtccaaaaattgtaatttaaaaaacagtcaatggagagcattgccataagtaaaggcatcccctgcgtgataagattaccttcagaaaacagatagttgctgggttatcgcagatttttctcgcaaccaaataactgtaaataataactgtctctggggcgacggtaggctttatattgccaaatttcgcccgtgggagaaagctaggctattcaatgtttatggaggactgacctagatgagctattcatcaaaatacattttactaattagtgtccatggtttaattcggggagaaaaccttgagttgggcagagatgccgacaccggcgggcaaaccaaatatgtgctggaactggcccgggccttggtaaaaaatccccaggtggccagggtggatttgctgacccgtttaattaaagatcccaaagtagatgcagattatgcccagcctagagaactcattggcgatcgggcccagattgttcgcattgagtgcggcccggaggaatatattgccaaggaaatgctctgggactatttggataattttgctgaccatgccctggactatctcaaagaacagcccgaactgcccgatgtcatccatagccattacgccgatgcgggttacgtgggcaccagactttctcaccaattgggtattcctttggtgcacaccggacattccctgggtcgtagtaagcgcacccgtctcctgctcagtgggattaaagccgacgaaattgaaagccgttacaatatggcccgccggattaacgcggaggaagaaaccctaggatcagcggcgagggtgattaccagtacccatcaggaaatcgcagaacagtacgcccaatacgactattaccagccagaccagatgttggttattccccccggcactgatttagaaaagttttatccccccaaagggaacgagtgggaaacgcccattgttcaagagttgcaacgatttctacggcatccccgtaagcctattatcctcgctttgtcccgaccggatccccgcaaaaatatccataaattaattgcagcctatggccagtccccgcagttacaggcccaggccaatttggtcattgtggcgggcaatcgggatgacatcacggatctagaccaggggccgagggaagtactgacggatttactgttgaccattgaccgttacgatctctacggcaaagtggcttaccccaaacagaatcaggcggaggatgtgtatgctttgtttcgcctcactgctttatcccagggagtatttatcaatccggctttgacggaaccctttggtttaactttgattgaagcggcggcctgtggtgtgcccattgtggccacggaggatgggggcccggtggatattatcaaaaattgtcagaatggctatctaattaatcccctcgatgaagtggatattgcggataaattgctcaaagtactaaacgacaaacaacaatggcaattcctttctgaaagtggtctagagggagttaagcgccattattcttggccttcccacgttgaaagttatttagaagccatcaacgctctgacccaacagacttcagtgctgaaacgtagtgatttaaagcggcggcggactttgtactataacggtgccctggttactagtttggaccaaaatttactgggggcattacaggggggattaccgggcgatcgccagacgttggacgaattactggaagtgctgtatcaacatcgaaaaaatgtcggcttttgcattgccactgggagaagattggattcggtgctgaaaattttgcgggagtatcgcattccccaaccggatatgttgatcaccagcatgggcacggaaatttattcttccccggatttgatccccgaccagagttggcgcaatcacattgattatttgtggaaccgtaacgccattgtgcgtattttgggggaattacccggtttagccctccaacccaaggaagaactgagcgcctataaaattagctatttctacgatgcggcgatcgcccctaacctagaagaaattcggcaactgttgcataaaggggaacaaaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttccagtcatcaccatcaccatcattaacgtagtcatcagcaaggaaaacttttaaatcgatgcgacagttattgctaatttctgacctggacaatacctgggtcggagatcaacaagccctggaacatttgcaagaatatctaggcgatcgccggggaaatttttatttggcctatgccacggggcgttcctaccattccgcgagggagttgcaaaaacaggtgggactcatggaaccggactattggctcaccgcggtggggagtgaaatttaccatccagaaggcctggaccaacattgggctgattacctctctgagcattggcaacgggatatcctccaggcgatcgccgatggttttgaggccttaaaaccccaatctcccttggaacaaaacccatggaaaattagctatcatctcgatccccaggcttgccccaccgtcatcgaccaattaacggagatgttgaaggaaaccggcatcccggtgcaggtgattttcagcagtggcaaagatgtggatttattgccccaacggagtaacaaaggtaacgccacccaatatctgcaacaacatttagccatggagccgtctcaaaccctggtgtgtggggactccggcaatgatattggcttatttgaaacttccgctcggggtgtcattgtccgtaatgcccagccggaattattgcactggtatgaccaatggggggattctcgtcattatcgggcccaatcgagccatgctggcgctatcctagaggcgatcgcccatttcgattttttgagctctagccatcatcaccatcaccattaagttacagttttggcaattactaaaaaactgacttcaattcaatgttagcccgctcccgcgggttttttgttgctttttcacagtgactataggtaatcagcaacacaatacggccctgttctttggacagtttttgtataatggcggccgcgtttcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 213 - DNA, 35 bp, Artificial Sequence
  SPSSPPrubop-F
gaggacagatctagatgagctattcatcaaaatac

SEQ ID NO: 214 - DNA, 23 bp, Artificial Sequence
  SPSSPPrubop-R
gaacctcttacgtgccgatcatc

SEQ ID NO: 215 - DNA, 3171 bp, Artificial Sequence
  SPSSPP Rubisco-like Operon PCR
gaggacagatctagatgagctattcatcaaaatacattttactaattagtgtccatggtttaattcggggagaaaaccttgagttgggcagagatgccgacaccggcgggcaaaccaaatatgtgctggaactggcccgggccttggtaaaaaatccccaggtggccagggtggatttgctgacccgtttaattaaagatcccaaagtagatgcagattatgcccagcctagagaactcattggcgatcgggcccagattgttcgcattgagtgcggcccggaggaatatattgccaaggaaatgctctgggactatttggataattttgctgaccatgccctggactatctcaaagaacagcccgaactgcccgatgtcatccatagccattacgccgatgcgggttacgtgggcaccagactttctcaccaattgggtattcctttggtgcacaccggacattccctgggtcgtagtaagcgcacccgtctcctgctcagtgggattaaagccgacgaaattgaaagccgttacaatatggcccgccggattaacgcggaggaagaaaccctaggatcagcggcgagggtgattaccagtacccatcaggaaatcgcagaacagtacgcccaatacgactattaccagccagaccagatgttggttattccccccggcactgatttagaaaagttttatccccccaaagggaacgagtgggaaacgcccattgttcaagagttgcaacgatttctacggcatccccgtaagcctattatcctcgctttgtcccgaccggatccccgcaaaaatatccataaattaattgcagcctatggccagtccccgcagttacaggcccaggccaatttggtcattgtggcgggcaatcgggatgacatcacggatctagaccaggggccgagggaagtactgacggatttactgttgaccattgaccgttacgatctctacggcaaagtggcttaccccaaacagaatcaggcggaggatgtgtatgctttgtttcgcctcactgctttatcccagggagtatttatcaatccggctttgacggaaccctttggtttaactttgattgaagcggcggcctgtggtgtgcccattgtggccacggaggatgggggcccggtggatattatcaaaaattgtcagaatggctatctaattaatcccctcgatgaagtggatattgcggataaattgctcaaagtactaaacgacaaacaacaatggcaattcctttctgaaagtggtctagagggagttaagcgccattattcttggccttcccacgttgaaagttatttagaagccatcaacgctctgacccaacagacttcagtgctgaaacgtagtgatttaaagcggcggcggactttgtactataacggtgccctggttactagtttggaccaaaatttactgggggcattacaggggggattaccgggcgatcgccagacgttggacgaattactggaagtgctgtatcaacatcgaaaaaatgtcggcttttgcattgccactgggagaagattggattcggtgctgaaaattttgcgggagtatcgcattccccaaccggatatgttgatcaccagcatgggcacggaaatttattcttccccggatttgatccccgaccagagttggcgcaatcacattgattatttgtggaaccgtaacgccattgtgcgtattttgggggaattacccggtttagccctccaacccaaggaagaactgagcgcctataaaattagctatttctacgatgcggcgatcgcccctaacctagaagaaattcggcaactgttgcataaaggggaacaaaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttccagtcatcaccatcaccatcattaacgtagtcatcagcaaggaaaacttttaaatcgatgcgacagttattgctaatttctgacctggacaatacctgggtcggagatcaacaagccctggaacatttgcaagaatatctaggcgatcgccggggaaatttttatttggcctatgccacggggcgttcctaccattccgcgagggagttgcaaaaacaggtgggactcatggaaccggactattggctcaccgcggtggggagtgaaatttaccatccagaaggcctggaccaacattgggctgattacctctctgagcattggcaacgggatatcctccaggcgatcgccgatggttttgaggccttaaaaccccaatctcccttggaacaaaacccatggaaaattagctatcatctcgatccccaggcttgccccaccgtcatcgaccaattaacggagatgttgaaggaaaccggcatcccggtgcaggtgattttcagcagtggcaaagatgtggatttattgccccaacggagtaacaaaggtaacgccacccaatatctgcaacaacatttagccatggagccgtctcaaaccctggtgtgtggggactccggcaatgatattggcttatttgaaacttccgctcggggtgtcattgtccgtaatgcccagccggaattattgcactggtatgaccaatggggggattctcgtcattatcgggcccaatcgagccatgctggcgctatcctagaggcgatcgcccatttcgattttttgagctctagccatcatcaccatcaccattaagttacagttttggcaattactaaaaaactgacttcaattcaatgttagcccgctcccgcgggttttttgttgctttttcacagtgactataggtaatcagcaacacaatacggccctgttctttggacagtttttgtataatggcggccgcgtttcgatgatcggcacgtaagaggttc

SEQ ID NO: 216 - DNA, 9455 bp, Artificial Sequence
  pLybAL82
atcgtccattccgacagcatcgccagtcactatggcgtgctgctagagaattcgtcgacgagctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatggggccgccattatacaaaaactgtccaaagaacagggccgtattgtgttgctgattacctatagtcactgtgaaaaagcaacaaaaaacccgcgggagcgggctaacattgaattgaagtcagttttttagtaattgccaaaactgtaacttaatggtgatggtgatgatggctagagctcaaaaaatcgaaatgggcgatcgcctctaggatagcgccagcatggctcgattgggcccgataatgacgagaatccccccattggtcataccagtgcaataattccggctgggcattacggacaatgacaccccgagcggaagtttcaaataagccaatatcattgccggagtccccacacaccagggtttgagacggctccatggctaaatgttgttgcagatattgggtggcgttacctttgttactccgttggggcaataaatccacatctttgccactgctgaaaatcacctgcaccgggatgccggtttccttcaacatctccgttaattggtcgatgacggtggggcaagcctggggatcgagatgatagctaattttccatgggttttgttccaagggagattggggttttaaggcctcaaaaccatcggcgatcgcctggaggatatcccgttgccaatgctcagagaggtaatcagcccaatgttggtccaggccttctggatggtaaatttcactccccaccgcggtgagccaatagtccggttccatgagtcccacctgtttttgcaactccctcgcggaatggtaggaacgccccgtggcataggccaaataaaaatttccccggcgatcgcctagatattcttgcaaatgttccagggcttgttgatctccgacccaggtattgtccaggtcagaaattagcaataactgtcgcatcgatttaaaagttttccttgctgatgactacgttaatgatggtgatggtgatgactggaaacggggtctaacaactcaaagaagcggtaatgggccagaccgtccagaataccggcggcgtaacgtttttcggaaaaataaatcggttcgatctcccctagattagaaagttcctcatggtgacggttagccacgacgacggaaagggtgttaccccgcatcatatcttcgtcggctcccgatcctccggcggtgaaaacgtgctccaggggaatattccactgttggctcaaccaacgcacagcatagcctttggaagctcggatgggcagaatatccaaaaattgaccaaaggaaatgatggtatttacggtttgttcccctttatgcaacagttgccgaatttcttctaggttaggggcgatcgccgcatcgtagaaatagctaattttataggcgctcagttcttccttgggttggagggctaaaccgggtaattcccccaaaatacgcacaatggcgttacggttccacaaataatcaatgtgattgcgccaactctggtcggggatcaaatccggggaagaataaatttccgtgcccatgctggtgatcaacatatccggttggggaatgcgatactcccgcaaaattttcagcaccgaatccaatcttctcccagtggcaatgcaaaagccgacattttttcgatgttgatacagcacttccagtaattcgtccaacgtctggcgatcgcccggtaatcccccctgtaatgcccccagtaaattttggtccaaactagtaaccagggcaccgttatagtacaaagtccgccgccgctttaaatcactacgtttcagcactgaagtctgttgggtcagagcgttgatggcttctaaataactttcaacgtgggaaggccaagaataatggcgcttaactccctctagaccactttcagaaaggaattgccattgttgtttgtcgtttagtactttgagcaatttatccgcaatatccacttcatcgaggggattaattagatagccattctgacaatttttgataatatccaccgggcccccatcctccgtggccacaatgggcacaccacaggccgccgcttcaatcaaagttaaaccaaagggttccgtcaaagccggattgataaatactccctgggataaagcagtgaggcgaaacaaagcatacacatcctccgcctgattctgtttggggtaagccactttgccgtagagatcgtaacggtcaatggtcaacagtaaatccgtcagtacttccctcggcccctggtctagatccgtgatgtcatcccgattgcccgccacaatgaccaaattggcctgggcctgtaactgcggggactggccataggctgcaattaatttatggatatttttgcggggatccggtcgggacaaagcgaggataataggcttacggggatgccgtagaaatcgttgcaactcttgaacaatgggcgtttcccactcgttccctttggggggataaaacttttctaaatcagtgccggggggaataaccaacatctggtctggctggtaatagtcgtattgggcgtactgttctgcgatttcctgatgggtactggtaatcaccctcgccgctgatcctagggtttcttcctccgcgttaatccggcgggccatattgtaacggctttcaatttcgtcggctttaatcccactgagcaggagacgggtgcgcttactacgacccagggaatgtccggtgtgcaccaaaggaatacccaattggtgagaaagtctggtgcccacgtaacccgcatcggcgtaatggctatggatgacatcgggcagttcgggctgttctttgagatagtccagggcatggtcagcaaaattatccaaatagtcccagagcatttccttggcaatatattcctccgggccgcactcaatgcgaacaatctgggcccgatcgccaatgagttctctaggctgggcataatctgcatctactttgggatctttaattaaacgggtcagcaaatccaccctggccacctggggattttttaccaaggcccgggccagttccagcacatatttggtttgcccgccggtgtcggcatctctgcccaactcaaggttttctccccgaattaaaccatggacactaattagtaaaatgtattttgatgaatagctcatctagatccttccaagatgtcactctttttacttatcaaatcacgttttggtacaatttcctctcacaattgccctacctccctatcagccaggagaaaaacaggaataatcttttggtagaggtcagcgacctttctgcaactaacacttagctttagtggtaatcctcttcaccagtgtcttgctcatctaggagtgcataagttaacgcttttactttttcctcttgccatagttaaaaaattcttttttatctgttcttctcacccactaaattgcttttatcccttcacgaccttcgcggtttacggaaagtatgagatgattcccctatatttcggggtatttaatgaattgggttagttttcacacattcccgcttctgcactcttgccgacctcctttattgacaggagacgagctaagagccaatttacttgacggatatttagtagagtaatcagcgcaagatgaaaaaattgcacaccacgtaatttgtaacttgtctcacaatatatcaagaaatggcataagttattctttgaaagttcttaacttacatatttaaatttgttattacataaagttttaaacgttttgttaacaatcagttacaaaatgtatcaatgactgtataggagtcagttgtcagttgccaatagtcattcctgcaggcatgcaaaaaagcccctgcccaaaggcaggagctgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaagtcgtcgacgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatg

SEQ ID NO: 217 - DNA, 9147 bp, Artificial Sequence
  pLybAL83
atcgtccattccgacagcatcgccagtcactatggcgtgctgctagagaattcgtcgacgagctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatggggccgccattatacaaaaactgtccaaagaacagggccgtattgtgttgctgattacctatagtcactgtgaaaaagcaacaaaaaacccgcgggagcgggctaacattgaattgaagtcagttttttagtaattgccaaaactgtaacttaatggtgatggtgatgatggctagagctcaaaaaatcgaaatgggcgatcgcctctaggatagcgccagcatggctcgattgggcccgataatgacgagaatccccccattggtcataccagtgcaataattccggctgggcattacggacaatgacaccccgagcggaagtttcaaataagccaatatcattgccggagtccccacacaccagggtttgagacggctccatggctaaatgttgttgcagatattgggtggcgttacctttgttactccgttggggcaataaatccacatctttgccactgctgaaaatcacctgcaccgggatgccggtttccttcaacatctccgttaattggtcgatgacggtggggcaagcctggggatcgagatgatagctaattttccatgggttttgttccaagggagattggggttttaaggcctcaaaaccatcggcgatcgcctggaggatatcccgttgccaatgctcagagaggtaatcagcccaatgttggtccaggccttctggatggtaaatttcactccccaccgcggtgagccaatagtccggttccatgagtcccacctgtttttgcaactccctcgcggaatggtaggaacgccccgtggcataggccaaataaaaatttccccggcgatcgcctagatattcttgcaaatgttccagggcttgttgatctccgacccaggtattgtccaggtcagaaattagcaataactgtcgcatcgatttaaaagttttccttgctgatgactacgttaatgatggtgatggtgatgactggaaacggggtctaacaactcaaagaagcggtaatgggccagaccgtccagaataccggcggcgtaacgtttttcggaaaaataaatcggttcgatctcccctagattagaaagttcctcatggtgacggttagccacgacgacggaaagggtgttaccccgcatcatatcttcgtcggctcccgatcctccggcggtgaaaacgtgctccaggggaatattccactgttggctcaaccaacgcacagcatagcctttggaagctcggatgggcagaatatccaaaaattgaccaaaggaaatgatggtatttacggtttgttcccctttatgcaacagttgccgaatttcttctaggttaggggcgatcgccgcatcgtagaaatagctaattttataggcgctcagttcttccttgggttggagggctaaaccgggtaattcccccaaaatacgcacaatggcgttacggttccacaaataatcaatgtgattgcgccaactctggtcggggatcaaatccggggaagaataaatttccgtgcccatgctggtgatcaacatatccggttggggaatgcgatactcccgcaaaattttcagcaccgaatccaatcttctcccagtggcaatgcaaaagccgacattttttcgatgttgatacagcacttccagtaattcgtccaacgtctggcgatcgcccggtaatcccccctgtaatgcccccagtaaattttggtccaaactagtaaccagggcaccgttatagtacaaagtccgccgccgctttaaatcactacgtttcagcactgaagtctgttgggtcagagcgttgatggcttctaaataactttcaacgtgggaaggccaagaataatggcgcttaactccctctagaccactttcagaaaggaattgccattgttgtttgtcgtttagtactttgagcaatttatccgcaatatccacttcatcgaggggattaattagatagccattctgacaatttttgataatatccaccgggcccccatcctccgtggccacaatgggcacaccacaggccgccgcttcaatcaaagttaaaccaaagggttccgtcaaagccggattgataaatactccctgggataaagcagtgaggcgaaacaaagcatacacatcctccgcctgattctgtttggggtaagccactttgccgtagagatcgtaacggtcaatggtcaacagtaaatccgtcagtacttccctcggcccctggtctagatccgtgatgtcatcccgattgcccgccacaatgaccaaattggcctgggcctgtaactgcggggactggccataggctgcaattaatttatggatatttttgcggggatccggtcgggacaaagcgaggataataggcttacggggatgccgtagaaatcgttgcaactcttgaacaatgggcgtttcccactcgttccctttggggggataaaacttttctaaatcagtgccggggggaataaccaacatctggtctggctggtaatagtcgtattgggcgtactgttctgcgatttcctgatgggtactggtaatcaccctcgccgctgatcctagggtttcttcctccgcgttaatccggcgggccatattgtaacggctttcaatttcgtcggctttaatcccactgagcaggagacgggtgcgcttactacgacccagggaatgtccggtgtgcaccaaaggaatacccaattggtgagaaagtctggtgcccacgtaacccgcatcggcgtaatggctatggatgacatcgggcagttcgggctgttctttgagatagtccagggcatggtcagcaaaattatccaaatagtcccagagcatttccttggcaatatattcctccgggccgcactcaatgcgaacaatctgggcccgatcgccaatgagttctctaggctgggcataatctgcatctactttgggatctttaattaaacgggtcagcaaatccaccctggccacctggggattttttaccaaggcccgggccagttccagcacatatttggtttgcccgccggtgtcggcatctctgcccaactcaaggttttctccccgaattaaaccatggacactaattagtaaaatgtattttgatgaatagctcatctagatccttccaaggcacaccacgtaatttgtaacttgtctcacaatatatcaagaaatggcataagttattctttgaaagttcttaacttacatatttaaatttgttattacataaagttttaaacgttttgttaacaatcagttacaaaatgtatcaatgactgtataggagtcagttgtcagttgccaatagtcattggtcaatagtccatagtcattcttctttacttcccctgcctcctctacttatcctctgccccctgccttttcccaatccccaatccccatatgtttaaaaaatcccaactaagggaagactgagattaacctttggtcagtttcgctaatggctggagcctgcaggcatgcaaaaaagcccctgcccaaaggcaggagctgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaagtcgtcgacgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatg

SEQ ID NO: 218 - DNA, 25 bp, Artificial Sequence
  primer for upp locus of Synechocystis sp. PCC 6803
cacacaggaaacagctatgaccatg

SEQ ID NO: 219 - DNA, 28 bp, Artificial Sequence
  primer for upp locus of Synechocystis sp. PCC 6803
cttaactctgcagcatcagagcagattg

SEQ ID NO: 220 - DNA, 2138 bp, Artificial Sequence
  DNA fragment containing an aminoglycoside 3'-phosphotransferase gene (aph) and the uracil phosphoribosyl transferase gene (upp) from Bacillus subtilis 168
cttaactctgcagcatcagagcagattgtactgagagtgcactgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgaccaaaatcccttaacgtgagttttggcgccattcgccattcagctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcccactcccgggatttggtaccttattttgttccaaacatgcggtcacccgcatctccgagacctggaacaatatatcctttttcatttaatttttcatctagcgccgcaatgtaaatatcaacgtccgaatgatgcttctgcaattcttccacaccctccggcgctgctacaagacacatgaaacggatatttttcgcaccgcgttttttaaggctgtgaatggcttcaactgcggaaccgcctgtagcgagcatcgggtcaaccacgatgaattcacgctcttccacatcagaaggaagcttgacatagtattccacgggttttaaggtttctggatcacggtaaaggccgacatgtcccacttttgccgcaggaatcagctttaaaatgccgtcaaccattcccaatcctgctctgaggataggaaccactccgagttttttccctgagatgactttcgatttcgcagcctgaaccggtgtattgatatccacttcttccagaggaagatcgcgggtaatttcaaatgccatgagtgtagccacttcatctactaactctctaaaatccttcgtacctgtattttcattccgtatatatgtcagcttgtgctgaattaaaggatgatcaaatacataaacctttcccatactgtgtttcagctccttttttattgtcccatcaacaattacacacttctattgattctacaaaaaaagacattgagtttcaagaacatcgtcaaaaaacccgccgggcataagcccaagcgggttttaggatcttaataatctaattctttatataaaggaaatttatcagtcagagcagctacacgctgtcttgcttcttgtgggatcctctagagtcgacctgcaggcatgcaagcttgagtattctatagtctcacctaaatagcttggcgtaatcatggtcatagctgtttcctgtgtg

SEQ ID NO: 221 - DNA, 6112 bp, Artificial Sequence
  plasmid
gcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcttgcatgccagtttagcaggaggagccaatcgtcccctggtaatttccattttggccggggtttctctgcaaagaattcaaaagggttttcccgaccatgccatcatccgggccatgcccaatacccccgccaccgttggggccggtatgacggcgatcgccgcgaataaaatggtggagccggatcagttggctaaggctaaggccatcttttcggcggtgggcaatgtggtggaggtgccggaaaatttaatggatgcggtgacgggggtttccggttcgggaccggcctacgtagctttgatgatcgaagccctggccgatggtggtgttttggccggattacccagggcgatcgcccaaaaattggctttgcaaacagtgttgggcacagcggagttaatcaaggaaacggaggagcaccctgcccagattaaagataaagttaccagtccggggggcaccaccattgctggggtagcggtattggagaagatgggttttcgttccgccatcatcgaagcagtgcgggcggcctatcgccgttcccaggaattgggcaaaaaataaatggacaacggaatttaatgcagcgcttgatgcaaacttttcaaactaggcaaatcgaacatcaaagcatcgtcggggttaacttctgtgaaatggtgtactagcaataggcccacaatggtccaggtttggtaggaacgggattgttgcccgacccaaaagcccgtggggccatcaaaatattcagcccatttatgcttgggcaaacggcgcaaaagcacctgcagcatcagagcagattgtactgagagtgcactgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgaccaaaatcccttaacgtgagttttggcgccattcgccattcagctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcccactcccgggatttggtaccttattttgttccaaacatgcggtcacccgcatctccgagacctggaacaatatatcctttttcatttaatttttcatctagcgccgcaatgtaaatatcaacgtccgaatgatgcttctgcaattcttccacaccctccggcgctgctacaagacacatgaaacggatatttttcgcaccgcgttttttaaggctgtgaatggcttcaactgcggaaccgcctgtagcgagcatcgggtcaaccacgatgaattcacgctcttccacatcagaaggaagcttgacatagtattccacgggttttaaggtttctggatcacggtaaaggccgacatgtcccacttttgccgcaggaatcagctttaaaatgccgtcaaccattcccaatcctgctctgaggataggaaccactccgagttttttccctgagatgactttcgatttcgcagcctgaaccggtgtattgatatccacttcttccagaggaagatcgcgggtaatttcaaatgccatgagtgtagccacttcatctactaactctctaaaatccttcgtacctgtattttcattccgtatatatgtcagcttgtgctgaattaaaggatgatcaaatacataaacctttcccatactgtgtttcagctccttttttattgtcccatcaacaattacacacttctattgattctacaaaaaaagacattgagtttcaagaacatcgtcaaaaaacccgccgggcataagcccaagcgggttttaggatcttaataatctaattctttatataaaggaaatttatcagtcagagcagctacacgctgtcttgcttcttgtgggatcctctagagtcgaccatggctttttcgtagagcaaacggcgggcctggtctaggatttgttgagcctggggggatttcatagcaaaagattaggattaatctatgggtcaaacttaattttcctgaactagtctgacgatgtaaagcatttggtttgctaggctgacagatagtagggttctagctcgttccctcaatatccaatatcccaacactggcagatttttacccggctttccctgaaactggtggatcaggggatttttaaaatttaccctaggccgacagatgggcgatcgccacattgccaatggagctatcaaaactaacattgagcaatgtttgccaacgggctaaaatttcctgttctcccctacggttaatgtcatccaaaatgatggtgctgtggggtgccaattgcggttggaaaaaaggcactgcaggaaaccgggaatattgaatgtcttctcggtaggcgggcggtccatctactaacaggcaatcaatggttttgctagcgggcaactggtgacggatcttctggcgatcgtaccactgtccattgtccaaggccagttcgcagggttccaagggggcatggatgagctggacataggtgtctagaggatccccgggtaccgagctcgaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 222 - DNA, 3661 bp, Artificial Sequence
  invertase kncok out
cgtaaacatctatccattgtggaatgtggtggtggagtatctacgttgtacattgcccgtttatttcgtcgcaatggtttgcagggccgactccactgtatcgaaaataatttggattggttaaattttttgcatgatgcattggcgagggaagatctagacacctatgtccagctcatccatgcccccttggaaccctgcgaactggccttggacaatggacagtggtacgatcgccagaagatccgtcaccagttgcccgctagcaaaaccattgattgcctgttagtagatggaccgcccgcctaccgagaagacattcaatattcccggtttcctgcagtgccttttttccaaccgcaattggcaccccacagcaccatcattttggatgacattaaccgtaggggagaacaggaaattttagcccgttggcaaacattgctcaatgttagttttgatagctccattggcaatgtggcgatcgcccatctgtcggcctagggtaaattttaaaaatcccctgatccaccagtttcagggaaagccgggtaaaaatctgccagtgttgggatattggatattgagggaacgagctagaaccctactatctgtcagcctagcaaaccaaatgctttacatcgtcagactagttcaggaaaattaagtttgacccatagattaatcctaatcttttgctatgaaatccccccaggctcaacaaatcctagaccaggcccgccgtttgctctacgaaaaagccatggtcgactctagaggatcccacaagaagcaagacagcgtgtagctgctctgactgataaatttcctttatataaagaattagattattaagatcctaaaacccgcttgggcttatgcccggcgggttttttgacgatgttcttgaaactcaatgtctttttttgtagaatcaatagaagtgtgtaattgttgatgggacaataaaaaaggagctgaaacacagtatgggaaaggtttatgtatttgatcatcctttaattcagcacaagctgacatatatacggaatgaaaatacaggtacgaaggattttagagagttagtagatgaagtggctacactcatggcatttgaaattacccgcgatcttcctctggaagaagtggatatcaatacaccggttcaggctgcgaaatcgaaagtcatctcagggaaaaaactcggagtggttcctatcctcagagcaggattgggaatggttgacggcattttaaagctgattcctgcggcaaaagtgggacatgtcggcctttaccgtgatccagaaaccttaaaacccgtggaatactatgtcaagcttccttctgatgtggaagagcgtgaattcatcgtggttgacccgatgctcgctacaggcggttccgcagttgaagccattcacagccttaaaaaacgcggtgcgaaaaatatccgtttcatgtgtcttgtagcagcgccggagggtgtggaagaattgcagaagcatcattcggacgttgatatttacattgcggcgctagatgaaaaattaaatgaaaaaggatatattgttccaggtctcggagatgcgggtgaccgcatgtttggaacaaaataaggtaccaaatcccgggagtgggatccccgggtaccgagctcgaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagctgaatggcgaatggcgccaaaactcacgttaagggattttggtcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcagtgcactctcagtacaatctgctctgatgctgcaggtgcttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccatttattttttgcccaattcctgggaacggcgataggccgcccgcactgcttcgatgatggcggaacgaaaacccatcttctccaataccgctaccccagcaatggtggtgccccccggactggtaactttatctttaatctgggcagggtgctcctccgtttccttgattaactccgctgtgcccaacactgtttgcaaagccaatttttgggcgatcgccctgggtaatccggccaaaacaccaccatcggccagggcttcgatcatcaaagctacgtaggccggtcccgaaccggaaacccccgtcaccgcatccattaaattttccggcacctccaccacattgcccaccgccgaaaagatggccttagccttagccaactgatccggctccaccattttattcgcggcgatcgccgtcataccggccccaacggtggcgggggtattgggcatggcccggatgatggcatggtcgggaaaacccttttgaattctttgcagagaaaccccggccaaaatggaaattaccaggggacgattggctcctcctgctaaactggcatgcacccggtctagcacctggggtttgacggccaacagcagcacttcagaaacattagc

SEQ ID NO: 223 - DNA, 29 bp, Artificial Sequence
  primer
taagtcgtcgacccgtgtgctctacgacc

SEQ ID NO: 224 - DNA, 31 bp, Artificial Sequence
  primer
aagccgcctgcaggaaagacataatcgattc

SEQ ID NO: 225 - DNA, 25 bp, Artificial Sequence
  primer
cggctctagagcccaactaatcacc

SEQ ID NO: 226 - DNA, 30 bp, Artificial Sequence
  primer
cctccttaagcattgaatagcctagctttc

SEQ ID NO: 227 - DNA, 287 bp, Artificial Sequence
  promoter
cggctctagagcccaactaatcaccatttggacaaaacatcaggaattctaattagaaagtccaaaaattgtaatttaaaaaacagtcaatggagagcattgccataagtaaaggcatcccctgcgtgataagattaccttcagaaaacagatagttgctgggttatcgcagatttttctcgcaaccaaataactgtaaataataactgtctctggggcgacggtaggctttatattgccaaatttcgcccgtgggagaaagctaggctattcaatgcttaaggagg

SEQ ID NO: 228 - DNA, 10946 bp, Artificial Sequence
  plasmid
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggtcgactctagagcccaactaatcaccatttggacaaaacatcaggaattctaattagaaagtccaaaaattgtaatttaaaaaacagtcaatggagagcattgccataagtaaaggcatcccctgcgtgataagattaccttcagaaaacagatagttgctgggttatcgcagatttttctcgcaaccaaataactgtaaataataactgtctctggggcgacggtaggctttatattgccaaatttcgcccgtgggagaaagctaggctattcaatgcttaagaaggaggatccatatggtaccgagctcgaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 229 - DNA, 26 bp, Artificial Sequence
  primer
acagtctagattggaattggctcaag

SEQ ID NO: 230 - DNA, 32 bp, Artificial Sequence
  primer
ctctcccttaagatatgtcagatatgctcgac

SEQ ID NO: 231 - DNA, 464 bp, Artificial Sequence
  promoter
acagtctagattggaattggctcaagagacaccgctcgccgagcccttagagctccccaatcctcgtgatgatcagtgatggaaaaagcactgtaattcccttggtttttggctgaaagtttcggactcagtagacctaagtacagagtgatgtcaacgccttcaagctagacgggaggcggcttttgccatggttcagcgatcgctcctcatcttcaataagcagggcatgagccagcgttaagcaaatcaaatcaaatctcgcttctgggcttcaataaatggttccgattgatgataggttgattcatgaggaatctaaggcttaattctccacaaaagaattaagcgtccgtcgcaacggaatgctccgctggacttgcgctgtgggactgcagctttacaggctccccctgccagaaatcctgaatcgtcgagcatatctgacatatcttaagggagag

SEQ ID NO: 232 - DNA, 11121 bp, Artificial Sequence
  plasmid
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggtcgactctagattggaattggctcaagagacaccgctcgccgagcccttagagctccccaatcctcgtgatgatcagtgatggaaaaagcactgtaattcccttggtttttggctgaaagtttcggactcagtagacctaagtacagagtgatgtcaacgccttcaagctagacgggaggcggcttttgccatggttcagcgatcgctcctcatcttcaataagcagggcatgagccagcgttaagcaaatcaaatcaaatctcgcttctgggcttcaataaatggttccgattgatgataggttgattcatgaggaatctaaggcttaattctccacaaaagaattaagcgtccgtcgcaacggaatgctccgctggacttgcgctgtgggactgcagctttacaggctccccctgccagaaatcctgaatcgtcgagcatatctgacatatcttaagaaggaggatccatatggtaccgagctcgaattggggcgttttctgtgaggctgactagcgcgtggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttaaccttttcagaatgagacgttgatcggcacgtaagcgtgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 233 - DNA, 2760 bp, Artificial Sequence
  Ssp6803 rbcLXS Operon
tcaccatttggacaaaacatcaggaattctaattagaaagtccaaaaattgtaatttaaaaaacagtcaatggagagcattgccataagtaaaggcatcccctgcgtgataagattaccttcagaaaacagatagttgctgggttatcgcagatttttctcgcaaccaaataactgtaaataataactgtctctggggcgacggtaggctttatattgccaaatttcgcccgtgggagaaagctaggctattcaatgtttatggaggactgacctagatggtacaagccaaagcagggtttaaggcgggcgtacaagattatcgcctgacctactatacccccgactacacccccaaggataccgacctgctcgcctgcttccgtatgaccccccaaccgggtgtacctgctgaagaagccgctgctgcggtggccgctgagtcttccaccggtacctggaccaccgtttggactgacaacctaactgacttggaccgctacaaaggtcgttgctatgacctggaagctgttcccaacgaagataaccaatattttgcttttattgcctatcctctagatttatttgaagaaggttccgtcaccaacgttttaacctctttggtcggtaacgtatttggttttaaggctctgcgggccctccgtttagaagatattcgttttcccgttgctttaattaaaaccttccaaggccctccccacggtattaccgttgagcgggacaaattaaacaaatacggtcgtcctctgcttggttgtaccatcaaacccaaacttggtctgtccgccaagaactacggtcgggctgtttacgaatgtctccggggtggtttggacttcaccaaagacgacgaaaacatcaactcccagcccttcatgcgttggcgcgatcgtttcctcttcgttcaagaggcgatcgaaaaagcccaggctgagaccaacgaaatgaaaggtcactacctgaacgtcaccgctggcacctgcgaagaaatgatgaaacgggccgagtttgccaaggaaattggcacccccatcatcatgcatgacttcttcaccggcggtttcactgccaacaccaccctcgctcgttggtgtcgggacaacggcattttgctccatattcaccgggcaatgcacgccgtagttgaccgtcagaaaaaccacgggatccacttccgggttttggccaagtgtctgcgtctgtccggcggtgaccacctccactccggtaccgtggttggtaaattggaaggggaacggggtatcaccatgggcttcgttgacctcatgcgcgaagattacgttgaggaagatcgctcccggggtattttcttcacccaagactatgcctccatgcctggcaccatgcccgtagcttccggtggtatccacgtatggcacatgcccgcgttggtggaaatcttcggtgatgattcctgcttacagtttggtggtggtactttgggtcacccctggggtaatgctcccggtgcaaccgctaaccgtgttgctttggaagcttgtgttcaagctcggaacgaaggtcgtaacctggctcgcgaaggtaatgacgttatccgggaagcctgtcgttggtcccctgagttggccgccgcctgcgaactctggaaagagatcaagtttgagttcgaggccatggataccctctaaaccggtgtttggattgtcggagttgtactcgtccgttaaggatgaacagttcttcggggttgagtctgctaactaattagccattaacagcggcttaactaacagttagtcattggcaattgtcaaaaaattgttaatcagccaaaacccactgcttactgatgttcaacttcgacagcaatttaccaattaccgggtagagtgttcatgcaaactaagcacatagctcaggcaacagtgaaagtactgcaaagttacctcacctaccaagccgttctcaggatccagagtgaactcggggaaaccaaccctccccaggccatttggttaaaccagtatttagccagtcacagtattcaaaatggagaaacgtttttgacggaactcctggatgaaaataaagaactggtactcaggatcctggcggtaagggaagacattgccgaatcagtgttagattttttgcccggtatgacccggaatagcttagcggaatctaacatcgcccaccgccgccatttgcttgaacgtctgacccgtaccgtagccgaagtcgataatttcccttcggaaacctccaacggagaatcaaacaacaacgattctcccccgtcctaacgtagtcatcagcaaggaaaacttttaaatcgatgaaaactttacccaaagagcgccgctacgaaaccctttcttacctgccccctttaaccgatcaacagattgctaaacaggttgagtttctgttagaccagggctttattcccggcgtggaatttgaagaagacccccaacccgaaacccacttctggaccatgtggaaactgcccttctttggtggtgccactgccaacgaagttctagccgaagtacgggaatgtcgttctgagaatcccaactgctacattcgggtgattggtttcgacaatatcaaacagtgccagactgtaagctttattgtccacaaacccaaccaaaaccaaggccgttactaagttacagttttggcaattactaaaaaactgacttcaattcaatgttagcccgctcccgcgggttttttgttgcttttt

SEQ ID NO: 234 - DNA, 836 bp, Artificial Sequence
  Nsp7120 rbc promoter region
cctgcaggctccagccattagcgaaactgaccaaaggttaatctcagtcttcccttagttgggattttttaaacatatggggattggggattgggaaaaggcagggggcagaggataagtagaggaggcaggggaagtaaagaagaatgactatggactattgaccaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgcaattttttcatcttgcgctgattactctactaaatatccgtcaagtaaattggctcttagctcgtctcctgtcaataaaggaggtcggcaagagtgcagaagcgggaatgtgtgaaaactaacccaattcattaaataccccgaaatataggggaatcatctcatactttccgtaaaccgcgaaggtcgtgaagggataaaagcaatttagtgggtgagaagaacagataaaaaagaattttttaactatggcaagaggaaaaagtaaaagcgttaacttatgcactcctagatgagcaagacactggtgaagaggattaccactaaagctaagtgttagttgcagaaaggtcgctgacctctaccaaaagattattcctgtttttctcctggctgatagggaggtagggcaattgtgagaggaaattgtaccaaaacgtgatttgataagtaaaaagagtgacatcttggaaggatccatatg

SEQ ID NO: 235 - DNA, 12317 bp, Artificial Sequence
  plasmid
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggctccagccattagcgaaactgaccaaaggttaatctcagtcttcccttagttgggattttttaaacatatggggattggggattgggaaaaggcagggggcagaggataagtagaggaggcaggggaagtaaagaagaatgactatggactattgaccaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgcaattttttcatcttgcgctgattactctactaaatatccgtcaagtaaattggctcttagctcgtctcctgtcaataaaggaggtcggcaagagtgcagaagcgggaatgtgtgaaaactaacccaattcattaaataccccgaaatataggggaatcatctcatactttccgtaaaccgcgaaggtcgtgaagggataaaagcaatttagtgggtgagaagaacagataaaaaagaattttttaactatggcaagaggaaaaagtaaaagcgttaacttatgcactcctagatgagcaagacactggtgaagaggattaccactaaagctaagtgttagttgcagaaaggtcgctgacctctaccaaaagattattcctgtttttctcctggctgatagggaggtagggcaattgtgagaggaaattgtaccaaaacgtgatttgataagtaaaaagagtgacatcttggaaggatctacctagatgagctattcatcaaaatacattttactaattagtgtccatggtttaattcggggagaaaaccttgagttgggcagagatgccgacaccggcgggcaaaccaaatatgtgctggaactggcccgggccttggtaaaaaatccccaggtggccagggtggatttgctgacccgtttaattaaagatcccaaagtagatgcagattatgcccagcctagagaactcattggcgatcgggcccagattgttcgcattgagtgcggcccggaggaatatattgccaaggaaatgctctgggactatttggataattttgctgaccatgccctggactatctcaaagaacagcccgaactgcccgatgtcatccatagccattacgccgatgcgggttacgtgggcaccagactttctcaccaattgggtattcctttggtgcacaccggacattccctgggtcgtagtaagcgcacccgtctcctgctcagtgggattaaagccgacgaaattgaaagccgttacaatatggcccgccggattaacgcggaggaagaaaccctaggatcagcggcgagggtgattaccagtacccatcaggaaatcgcagaacagtacgcccaatacgactattaccagccagaccagatgttggttattccccccggcactgatttagaaaagttttatccccccaaagggaacgagtgggaaacgcccattgttcaagagttgcaacgatttctacggcatccccgtaagcctattatcctcgctttgtcccgaccggatccccgcaaaaatatccataaattaattgcagcctatggccagtccccgcagttacaggcccaggccaatttggtcattgtggcgggcaatcgggatgacatcacggatctagaccaggggccgagggaagtactgacggatttactgttgaccattgaccgttacgatctctacggcaaagtggcttaccccaaacagaatcaggcggaggatgtgtatgctttgtttcgcctcactgctttatcccagggagtatttatcaatccggctttgacggaaccctttggtttaactttgattgaagcggcggcctgtggtgtgcccattgtggccacggaggatgggggcccggtggatattatcaaaaattgtcagaatggctatctaattaatcccctcgatgaagtggatattgcggataaattgctcaaagtactaaacgacaaacaacaatggcaattcctttctgaaagtggtctagagggagttaagcgccattattcttggccttcccacgttgaaagttatttagaagccatcaacgctctgacccaacagacttcagtgctgaaacgtagtgatttaaagcggcggcggactttgtactataacggtgccctggttactagtttggaccaaaatttactgggggcattacaggggggattaccgggcgatcgccagacgttggacgaattactggaagtgctgtatcaacatcgaaaaaatgtcggcttttgcattgccactgggagaagattggattcggtgctgaaaattttgcgggagtatcgcattccccaaccggatatgttgatcaccagcatgggcacggaaatttattcttccccggatttgatccccgaccagagttggcgcaatcacattgattatttgtggaaccgtaacgccattgtgcgtattttgggggaattacccggtttagccctccaacccaaggaagaactgagcgcctataaaattagctatttctacgatgcggcgatcgcccctaacctagaagaaattcggcaactgttgcataaaggggaacaaaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttccagtcatcaccatcaccatcattaacgtagtcatcagcaaggaaaacttttaaatcgatgcgacagttattgctaatttctgacctggacaatacctgggtcggagatcaacaagccctggaacatttgcaagaatatctaggcgatcgccggggaaatttttatttggcctatgccacggggcgttcctaccattccgcgagggagttgcaaaaacaggtgggactcatggaaccggactattggctcaccgcggtggggagtgaaatttaccatccagaaggcctggaccaacattgggctgattacctctctgagcattggcaacgggatatcctccaggcgatcgccgatggttttgaggccttaaaaccccaatctcccttggaacaaaacccatggaaaattagctatcatctcgatccccaggcttgccccaccgtcatcgaccaattaacggagatgttgaaggaaaccggcatcccggtgcaggtgattttcagcagtggcaaagatgtggatttattgccccaacggagtaacaaaggtaacgccacccaatatctgcaacaacatttagccatggagccgtctcaaaccctggtgtgtggggactccggcaatgatattggcttatttgaaacttccgctcggggtgtcattgtccgtaatgcccagccggaattattgcactggtatgaccaatggggggattctcgtcattatcgggcccaatcgagccatgctggcgctatcctagaggcgatcgcccatttcgattttttgagctctagccatcatcaccatcaccattaagttacagttttggcaattactaaaaaactgacttcaattcaatgttagcccgctcccgcgggttttttgttgctttttggcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 236 - DNA, 12159 bp, Artificial Sequence
  plasmid
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgcaattttttcatcttgcgctgattactctactaaatatccgtcaagtaaattggctcttagctcgtctcctgtcaataaaggaggtcggcaagagtgcagaagcgggaatgtgtgaaaactaacccaattcattaaataccccgaaatataggggaatcatctcatactttccgtaaaccgcgaaggtcgtgaagggataaaagcaatttagtgggtgagaagaacagataaaaaagaattttttaactatggcaagaggaaaaagtaaaagcgttaacttatgcactcctagatgagcaagacactggtgaagaggattaccactaaagctaagtgttagttgcagaaaggtcgctgacctctaccaaaagattattcctgtttttctcctggctgatagggaggtagggcaattgtgagaggaaattgtaccaaaacgtgatttgataagtaaaaagagtgacatcttggaaggatctacctagatgagctattcatcaaaatacattttactaattagtgtccatggtttaattcggggagaaaaccttgagttgggcagagatgccgacaccggcgggcaaaccaaatatgtgctggaactggcccgggccttggtaaaaaatccccaggtggccagggtggatttgctgacccgtttaattaaagatcccaaagtagatgcagattatgcccagcctagagaactcattggcgatcgggcccagattgttcgcattgagtgcggcccggaggaatatattgccaaggaaatgctctgggactatttggataattttgctgaccatgccctggactatctcaaagaacagcccgaactgcccgatgtcatccatagccattacgccgatgcgggttacgtgggcaccagactttctcaccaattgggtattcctttggtgcacaccggacattccctgggtcgtagtaagcgcacccgtctcctgctcagtgggattaaagccgacgaaattgaaagccgttacaatatggcccgccggattaacgcggaggaagaaaccctaggatcagcggcgagggtgattaccagtacccatcaggaaatcgcagaacagtacgcccaatacgactattaccagccagaccagatgttggttattccccccggcactgatttagaaaagttttatccccccaaagggaacgagtgggaaacgcccattgttcaagagttgcaacgatttctacggcatccccgtaagcctattatcctcgctttgtcccgaccggatccccgcaaaaatatccataaattaattgcagcctatggccagtccccgcagttacaggcccaggccaatttggtcattgtggcgggcaatcgggatgacatcacggatctagaccaggggccgagggaagtactgacggatttactgttgaccattgaccgttacgatctctacggcaaagtggcttaccccaaacagaatcaggcggaggatgtgtatgctttgtttcgcctcactgctttatcccagggagtatttatcaatccggctttgacggaaccctttggtttaactttgattgaagcggcggcctgtggtgtgcccattgtggccacggaggatgggggcccggtggatattatcaaaaattgtcagaatggctatctaattaatcccctcgatgaagtggatattgcggataaattgctcaaagtactaaacgacaaacaacaatggcaattcctttctgaaagtggtctagagggagttaagcgccattattcttggccttcccacgttgaaagttatttagaagccatcaacgctctgacccaacagacttcagtgctgaaacgtagtgatttaaagcggcggcggactttgtactataacggtgccctggttactagtttggaccaaaatttactgggggcattacaggggggattaccgggcgatcgccagacgttggacgaattactggaagtgctgtatcaacatcgaaaaaatgtcggcttttgcattgccactgggagaagattggattcggtgctgaaaattttgcgggagtatcgcattccccaaccggatatgttgatcaccagcatgggcacggaaatttattcttccccggatttgatccccgaccagagttggcgcaatcacattgattatttgtggaaccgtaacgccattgtgcgtattttgggggaattacccggtttagccctccaacccaaggaagaactgagcgcctataaaattagctatttctacgatgcggcgatcgcccctaacctagaagaaattcggcaactgttgcataaaggggaacaaaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttccagtcatcaccatcaccatcattaacgtagtcatcagcaaggaaaacttttaaatcgatgcgacagttattgctaatttctgacctggacaatacctgggtcggagatcaacaagccctggaacatttgcaagaatatctaggcgatcgccggggaaatttttatttggcctatgccacggggcgttcctaccattccgcgagggagttgcaaaaacaggtgggactcatggaaccggactattggctcaccgcggtggggagtgaaatttaccatccagaaggcctggaccaacattgggctgattacctctctgagcattggcaacgggatatcctccaggcgatcgccgatggttttgaggccttaaaaccccaatctcccttggaacaaaacccatggaaaattagctatcatctcgatccccaggcttgccccaccgtcatcgaccaattaacggagatgttgaaggaaaccggcatcccggtgcaggtgattttcagcagtggcaaagatgtggatttattgccccaacggagtaacaaaggtaacgccacccaatatctgcaacaacatttagccatggagccgtctcaaaccctggtgtgtggggactccggcaatgatattggcttatttgaaacttccgctcggggtgtcattgtccgtaatgcccagccggaattattgcactggtatgaccaatggggggattctcgtcattatcgggcccaatcgagccatgctggcgctatcctagaggcgatcgcccatttcgattttttgagctctagccatcatcaccatcaccattaagttacagttttggcaattactaaaaaactgacttcaattcaatgttagcccgctcccgcgggttttttgttgctttttggcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 237 - DNA, 11693 bp, Artificial Sequence
  plasmid
aggcccagtctttcgactgagcctttcgttttatttgatgcctggcagttccctactctcgcatggggagaccccacactaccatcggcgctacggcgtttcacttctgagttcggcatggggtcaggtgggaccaccgcgctactgccgccaggcaaattctgttttatcagaccgcttctgcgttctgatttaatctgtatcaggctgaaaatcttctctcatccgccaaaacagccaagcttgcatgcctgcaggaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgccttggaaggatctacctagatgagctattcatcaaaatacattttactaattagtgtccatggtttaattcggggagaaaaccttgagttgggcagagatgccgacaccggcgggcaaaccaaatatgtgctggaactggcccgggccttggtaaaaaatccccaggtggccagggtggatttgctgacccgtttaattaaagatcccaaagtagatgcagattatgcccagcctagagaactcattggcgatcgggcccagattgttcgcattgagtgcggcccggaggaatatattgccaaggaaatgctctgggactatttggataattttgctgaccatgccctggactatctcaaagaacagcccgaactgcccgatgtcatccatagccattacgccgatgcgggttacgtgggcaccagactttctcaccaattgggtattcctttggtgcacaccggacattccctgggtcgtagtaagcgcacccgtctcctgctcagtgggattaaagccgacgaaattgaaagccgttacaatatggcccgccggattaacgcggaggaagaaaccctaggatcagcggcgagggtgattaccagtacccatcaggaaatcgcagaacagtacgcccaatacgactattaccagccagaccagatgttggttattccccccggcactgatttagaaaagttttatccccccaaagggaacgagtgggaaacgcccattgttcaagagttgcaacgatttctacggcatccccgtaagcctattatcctcgctttgtcccgaccggatccccgcaaaaatatccataaattaattgcagcctatggccagtccccgcagttacaggcccaggccaatttggtcattgtggcgggcaatcgggatgacatcacggatctagaccaggggccgagggaagtactgacggatttactgttgaccattgaccgttacgatctctacggcaaagtggcttaccccaaacagaatcaggcggaggatgtgtatgctttgtttcgcctcactgctttatcccagggagtatttatcaatccggctttgacggaaccctttggtttaactttgattgaagcggcggcctgtggtgtgcccattgtggccacggaggatgggggcccggtggatattatcaaaaattgtcagaatggctatctaattaatcccctcgatgaagtggatattgcggataaattgctcaaagtactaaacgacaaacaacaatggcaattcctttctgaaagtggtctagagggagttaagcgccattattcttggccttcccacgttgaaagttatttagaagccatcaacgctctgacccaacagacttcagtgctgaaacgtagtgatttaaagcggcggcggactttgtactataacggtgccctggttactagtttggaccaaaatttactgggggcattacaggggggattaccgggcgatcgccagacgttggacgaattactggaagtgctgtatcaacatcgaaaaaatgtcggcttttgcattgccactgggagaagattggattcggtgctgaaaattttgcgggagtatcgcattccccaaccggatatgttgatcaccagcatgggcacggaaatttattcttccccggatttgatccccgaccagagttggcgcaatcacattgattatttgtggaaccgtaacgccattgtgcgtattttgggggaattacccggtttagccctccaacccaaggaagaactgagcgcctataaaattagctatttctacgatgcggcgatcgcccctaacctagaagaaattcggcaactgttgcataaaggggaacaaaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttccagtcatcaccatcaccatcattaacgtagtcatcagcaaggaaaacttttaaatcgatgcgacagttattgctaatttctgacctggacaatacctgggtcggagatcaacaagccctggaacatttgcaagaatatctaggcgatcgccggggaaatttttatttggcctatgccacggggcgttcctaccattccgcgagggagttgcaaaaacaggtgggactcatggaaccggactattggctcaccgcggtggggagtgaaatttaccatccagaaggcctggaccaacattgggctgattacctctctgagcattggcaacgggatatcctccaggcgatcgccgatggttttgaggccttaaaaccccaatctcccttggaacaaaacccatggaaaattagctatcatctcgatccccaggcttgccccaccgtcatcgaccaattaacggagatgttgaaggaaaccggcatcccggtgcaggtgattttcagcagtggcaaagatgtggatttattgccccaacggagtaacaaaggtaacgccacccaatatctgcaacaacatttagccatggagccgtctcaaaccctggtgtgtggggactccggcaatgatattggcttatttgaaacttccgctcggggtgtcattgtccgtaatgcccagccggaattattgcactggtatgaccaatggggggattctcgtcattatcgggcccaatcgagccatgctggcgctatcctagaggcgatcgcccatttcgattttttgagctctagccatcatcaccatcaccattaagttacagttttggcaattactaaaaaactgacttcaattcaatgttagcccgctcccgcgggttttttgttgctttttggcgatgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacacaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgcaagctggccgacgcgctgggctacgtcttgctggcgttcgggagcagaagagcatacatctggaagcaaagccaggaaagcggcctatggagctgtgcggcagcgctcagtaggcaatttttcaaaatattgttaagccttttctgagcatggtatttttcatggtattaccaattagcaggaaaataagccattgaatataaaagataaaaatgtcttgtttacaatagagtggggggggtcagcctgccgccttgggccgggtgatgtcgtacttgcccgccgcgaactcggttaccgtccagcccagcgcgaccagctccggcaacgcctcgcgcacccgcttgcggcgcttgcgcatggtcgaaccactggcctctgacggccagacatagccgcacaaggtatctatggaagccttgccggttttgccggggtcgatccagccacacagccgctggtgcagcaggcgggcggtttcgctgtccagcgcccgcacctcgtccatgctgatgcgcacatgctggccgccacccatgacggcctgcgcgatcaaggggttcagggccacgtacaggcgcccgtccgcctcgtcgctggcgtactccgacagcagccgaaacccctgccgcttgcggccattctgggcgatgatggataccttccaaaggcgctcgatgcagtcctgtatgtgcttgagcgccccaccactatcgacctctgccccgatttcctttgccagcgcccgatagctacctttgaccacatggcattcagcggtgacggcctcccacttgggttccaggaacagccggagctgccgtccgccttcggtcttgggttccgggccaagcactaggccattaggcccagccatggccaccagcccttgcaggatgcgcagatcatcagcgcccagcggctccgggccgctgaactcgatccgcttgccgtcgccgtagtcatacgtcacgtccagcttgctgcgcttgcgctcgccccgcttgagggcacggaacaggccgggggccagacagtgcgccgggtcgtgccggacgtggctgaggctgtgcttgttcttaggcttcaccacggggcacccccttgctcttgcgctgcctctccagcacggcgggcttgagcaccccgccgtcatgccgcctgaaccaccgatcagcgaacggtgcgccatagttggccttgctcacaccgaagcggacgaagaaccggcgctggtcgtcgtccacaccccattcctcggcctcggcgctggtcatgctcgacaggtaggactgccagcggatgttatcgaccagtaccgagctgccccggctggcctgctgctggtcgcctgcgcccatcatggccgcgcccttgctggcatggtgcaggaacacgatagagcacccggtatcggcggcgatggcctccatgcgaccgatgacctgggccatggggccgctggcgttttcttcctcgatgtggaaccggcgcagcgtgtccagcaccatcaggcggcggccctcggcggcgcgcttgaggccgtcgaaccactccggggccatgatgttgggcaggctgccgatcagcggctggatcagcaggccgtcagccacggcttgccgttcctcggcgctgaggtgcgccccaagggcgtgcaggcggtgatgaatggcggtgggcgggtcttcggcgggcaggtagatcaccgggccggtgggcagttcgcccacctccagcagatccggcccgcctgcaatctgtgcggccagttgcagggccagcatggatttaccggcaccaccgggcgacaccagcgccccgaccgtaccggccaccatgttgggcaaaacgtagtccagcggtggcggcgctgctgcgaacgcctccagaatattgataggcttatgggtagccattgattgcctcctttgcaggcagttggtggttaggcgctggcggggtcactacccccgccctgcgccgctctgagttcttccaggcactcgcgcagcgcctcgtattcgtcgtcggtcagccagaacttgcgctgacgcatccctttggccttcatgcgctcggcatatcgcgcttggcgtacagcgtcagggctggccagcaggtcgccggtctgcttgtccttttggtctttcatatcagtcaccgagaaacttgccggggccgaaaggcttgtcttcgcggaacaaggacaaggtgcagccgtcaaggttaaggctggccatatcagcgactgaaaagcggccagcctcggccttgtttgacgtataaccaaagccaccgggcaaccaatagcccttgtcacttttgatcaggtagaccgaccctgaagcgcttttttcgtattccataaaacccccttctgtgcgtgagtactcatagtataacaggcgtgagtaccaacgcaagcactacatgctgaaatctggcccgcccctgtccatgcctcgctggcggggtgccggtgcccgtgccagctcggcccgcgcaagctggacgctgggcagacccatgaccttgctgacggtgcgctcgatgtaatccgcttcgtggccgggcttgcgctctgccagcgctgggctggcctcggccatggccttgccgatttcctcggcactgcggccccggctggccagcttctgcgcggcgataaagtcgcacttgctgaggtcatgaccgaagcgcttgaccagcccggccatctcgctgcggtactcgtccagcgccgtgcgccggtggcggctaagctgccgctcgggcagttcgaggctggccagcctgcgggccttctcctgctgccgctgggcctgctcgatctgctggccagcctgctgcaccagcgccgggccagcggtggcggtcttgcccttggattcacgcagcagcacccacggctgataaccggcgcgggtggtgtgcttgtccttgcggttggtgaagcccgccaagcggccatagtggcggctgtcggcgctggccgggtcggcgtcgtactcgctggccagcgtccgggcaatctgcccccgaagttcaccgcctgcggcgtcggccaccttgacccatgcctgatagttcttcgggctggtttccactaccagggcaggctcccggccctcggctttcatgtcatccaggtcaaactcgctgaggtcgtccaccagcaccagaccatgccgctcctgctcggcgggcctgatatacacgtcattgccctgggcattcatccgcttgagccatggcgtgttctggagcacttcggcggctgaccattcccggttcatcatctggccggtgggtgcgtccctgacgccgatatcgaagcgctcacagcccatggccttgagctgtcggcctatggcctgcaaagtcctgtcgttcttcatcgggccaccaagcgcagccagatcgagccgtcctcggttgtcagtggcgtcaggtcgagcaagagcaacgatgcgatcagcagcaccaccgtaggcatcatggaagccagcatcacggttagccatagcttccagtgccacccccgcgacgcgctccgggcgctctgcgcggcgctgctcacctcggcggctacctcccgcaactctttggccagctccacccatgccgcccctgtctggcgctgggctttcagccactccgccgcctgcgcctcgctggcctgcttggtctggctcatgacctgccgggcttcgtcggccagtgtcgccatgctctgggccagcggttcgatctgctccgctaactcgttgatgcctctggatttcttcactctgtcgattgcgttcatggtctattgcctcccggtattcctgtaagtcgatgatctgggcgttggcggtgtcgatgttcagggccacgtctgcccggtcggtgcggatgccccggccttccatctccaccacgttcggccccaggtgaacaccgggcaggcgctcgatgccctgcgcctcaagtgttctgtggtcaatgcgggcgtcgtggccagcccgctctaatgcccggttggcatggtcggcccatgcctcgcgggtctgctcaagccatgccttgggcttgagcgcttcggtcttctgtgccccgcccttctccggggtcttgccgttgtaccgcttgaaccactgagcggcgggccgctcgatgccgtcattgatccgctcggagatcatcaggtggcagtgcgggttctcgccgccaccggcatggatggccagcgtatacggcaggcgctcggcaccggtcaggtgctgggcgaactcggacgccagcgccttctgctggtcgagggtcagctcgaccggcagggcaaattcgacctccttgaacagccgcccattggcgcgttcatacaggtcggcagcatcccagtagtcggcgggccgctcgacgaactccggcatgtgcccggattcggcgtgcaagacttcatccatgtcgcgggcatacttgccttcgcgctggatgtagtcggccttggccctggccgattggccgcccgacctgctgccggttttcgccgtaaggtgataaatcgccatgctgcctcgctgttgcttttgcttttcggctccatgcaatggccctcggagagcgcaccgcccgaagggtggccgttaggccagtttctcgaagagaaaccggtaagtgcgccctcccctacaaagtagggtcgggattgccgccgctgtgcctccatgatagcctacgagacagcacattaacaatggggtgtcaagatggttaaggggagcaacaaggcggcggatcggctggccaagctcgaagaacaacgagcgcgaatcaatgccgaaattcagcgggagcgggcaagggaacagcagcaagagcgcaagaacgaaacaaggcgcaaggtgctggtgggggccatgattttggccaaggtgaacagcagcgagtggccggaggatcggctcatggcggcaatggatgcgtaccttgaacgcgaccacgaccgcgccttgttcggtctgccgccacgccagaaggatgagccgggctgaatgatcgaccgagacaggccctgcggggctgcacacgcgcccccacccttcgggtagggggaaaggccgctaaagcggctaaaagcgctccagcgtatttctgcggggtttggtgtggggtttagcgggctttgcccgcctttccccctgccgcgcagcggtggggcggtgtgtagcctagcgcagcgaatagaccagctatccggcctctggccgggcatattgggcaagggcagcagcgccccacaagggcgctgataaccgcgcctagtggattattcttagataatcatggatggatttttccaacaccccgccagcccccgcccctgctgggtttgcaggtttgggggcgtgacagttattgcaggggttcgtgacagttattgcaggggggcgtgacagttattgcaggggttcgtgacagttagtacgggagtgacgggcactggctggcaatgtctagcaacggcaggcatttcggctgagggtaaaagaactttccgctaagcgatagactgtatgtaaacacagtattgcaaggacgcggaacatgcctcatgtggcggccaggacggccagccgggatcgggatactggtcgttaccagagccaccgacccgagcaaacccttctctatcagatcgttgacgagtattacccggcattcgctgcgcttatggcagagcagggaaaggaattgccgggctatgtgcaacgggaatttgaagaatttctccaatgcgggcggctggagcatggctttctacgggttcgctgcgagtcttgccacgccgagcacctggtcgctttcagaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaaagagtttgtagaaacgcaaaaaggccatccgtcaggatggccttctgcttaatttgatgcctggcagtttatggcgggcgtcctgcccgccaccctccgggccgttgcttcgcaacgttcaaatccgctcccggcggatttgtcctactcaggagagcgttcaccgacaaacaacagataaaacgaa

SEQ ID NO: 238 - DNA, 6754 bp, Artificial Sequence
  plasmid
atcgtccattccgacagcatcgccagtcactatggcgtgctgctagagaattcgtcgacgagctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatgggtaccgcggcagtgataagctgtcaaacatgagaattaattccggggatccgtcgacctgcagttcgaagttcctattctctagaaagtataggaacttcggcgcgcctacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaggcgcgccatttaaatgaagttcctattccgaagttcctattctctagaaagtataggaacttcgaagcagctccagcctacacaatcgctcaagacgtgtaatgctgcaccgcggcgccgtcgacctgcaggcatgcaaaaaagcccctgcccaaaggcaggagctgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaagtcgtcgacgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatg

SEQ ID NO: 239 - DNA, 9572 bp, Artificial Sequence
  plasmid
atcgtccattccgacagcatcgccagtcactatggcgtgctgctagagaattcgtcgacgagctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatgggtaccgcggcagtgataagctgtcaaacatgagaattaattccggggatccgtcgacctgcagttcgaagttcctattctctagaaagtataggaacttcggcgcgcctacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaggcgcgccatttaaatgaagttcctattccgaagttcctattctctagaaagtataggaacttcgaagcagctccagcctacacaatcgctcaagacgtgtaatgctgcaccgcggcccgatttaatgatggtgatggtgatggctagaagcgatcgcctcaaaaaagcgatagtgttttaaggcttccagaatgccattagcatagtggccctcagcaaaatagacgcgctcgtagctgcgcagtggctccaattccggtgagtaattgccaactacaacgccgagattatggcccttgagcatttcctcatcgttaccagaatcgcctgccaccaaaatgttctcaagaggaatccgccagcggagtgagaggtggcgaatcgcatcccctttcgaggcagctagcggcagaatgtcaagaaactcctgatgggaatagattgacttcagccgcaggcgatggcggcgaagatgttgccgtacttctcgcagcacagtctcgtggcgatcgcggacaaagaagctgactttgaagggtgtttgatcctcttccggctgcagttcaagaaagggtagttgtgccattactgcccgaattcgctgaggattccagttgcgattgatatgcttttcccagctgatatccggttcagcatcggtgccatagtgaatctcgctgccgacggaagtcacccagaagtttggcgaaggaacgccccactctttcaagacttcttgggcagagtctaggcgacgccccgtggcaattccaaaggcaaaatgatcgcgatactgatcgagataggtcattaaattctcgagtccttgacgatcgcccaacagtgtgttgtcgatgtcactaacgacaaggcgtttggcatcaatcaagcgtttgcgactccgtacgaaactgacagcacgacgacgaggcaaagccaccgtttccatgcgctcaaacagggtattgacatgttgatcccagctgtaatgggcgggaactttttcaatgccattgcggtgatagcactgccaaagatcgcgatcgctcagcagggtggcgagtgcagtcgcgatattagcgggtcggctgacatcaactaaagtgccgaaatcacagtgtttgagaatttcctgggggccgccatcatgggttgccaccaccggcacgccgcagcttcctgcctccaaaattgtcaaaccaaaaggttcggtcagcgccggattgacgaataccccgccggaatgagccgctaggcgatagaactccggcacatcatcagcctgatgctgtttgggataggcgacgctgccgtagaggtcgtagcgatcgaccagatggaaaatctcttggaacacctgccgactgccgcgatccatctggttgatgtcttggcggctgcccagtactaagacaaggttggcttttttgcgcagccaaggatgttcgccaaaggctcgcaccagcgccggtacatttttgcgaggtgcggggcgacagaggcagagaatttgaggtttttctgggtcgcgcagaaagcggctcagttcctgttggagaacaacaccgcgatcgcccaagggctgaaacctgaagcgatcggtatcgacacccggtggaatgacaagcttgcgctctgggttgtagcgatcgtaaacgcggtattgctcctccacttcctgctgagtgctggcgacaatccagtcagcatgagtgagcgtcatctcctccgcatcaattcgctgttgaatattgaattgcgcttcaatttcctcaagcggccagtcttgctccaacagcttttttagcttgatccgccccagagaatgccctgtgaaaattagcggtacattcaaccagcgactcagcagtgatcccacttggccagcatcagcatagtgggcctgaatccaagtcggggtgcgcttttgctgagccagatattggagaattgcatccgcaaaggtgtagagatggggccaaagcagctctttacggaggtagcgtttggggccaaaaggcaaacggacaatccgacctttgggcgcaaagggttcgatcgcctgactgtaaccaacactgacgcgggggtcggtgatttggcgggtgatgatgtcgacttgttggacttgtggggatttagcttgggcttgagccagttctaagacgtacttggtctgcccgccggtgtcggcatctcgccccagttccaagttctgccctcgcagcagaccatgggtctgaatgtgcagaatgtagagattttgagctgccatatggatccttccaagatgtcactctttttacttatcaaatcacgttttggtacaatttcctctcacaattgccctacctccctatcagccaggagaaaaacaggaataatcttttggtagaggtcagcgacctttctgcaactaacacttagctttagtggtaatcctcttcaccagtgtcttgctcatctaggagtgcataagttaacgcttttactttttcctcttgccatagttaaaaaattcttttttatctgttcttctcacccactaaattgcttttatcccttcacgaccttcgcggtttacggaaagtatgagatgattcccctatatttcggggtatttaatgaattgggttagttttcacacattcccgcttctgcactcttgccgacctcctttattgacaggagacgagctaagagccaatttacttgacggatatttagtagagtaatcagcgcaagatgaaaaaattgcacaccacgtaatttgtaacttgtctcacaatatatcaagaaatggcataagttattctttgaaagttcttaacttacatatttaaatttgttattacataaagttttaaacgttttgttaacaatcagttacaaaatgtatcaatgactgtataggagtcagttgtcagttgccaatagtcattcctgcaggcatgcaaaaaagcccctgcccaaaggcaggagctgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaagtcgtcgacgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatg

SEQ ID NO: 240 - DNA, 9264 bp, Artificial Sequence
  plasmid
atcgtccattccgacagcatcgccagtcactatggcgtgctgctagagaattcgtcgacgagctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatgggtaccgcggcagtgataagctgtcaaacatgagaattaattccggggatccgtcgacctgcagttcgaagttcctattctctagaaagtataggaacttcggcgcgcctacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaggcgcgccatttaaatgaagttcctattccgaagttcctattctctagaaagtataggaacttcgaagcagctccagcctacacaatcgctcaagacgtgtaatgctgcaccgcggcccgatttaatgatggtgatggtgatggctagaagcgatcgcctcaaaaaagcgatagtgttttaaggcttccagaatgccattagcatagtggccctcagcaaaatagacgcgctcgtagctgcgcagtggctccaattccggtgagtaattgccaactacaacgccgagattatggcccttgagcatttcctcatcgttaccagaatcgcctgccaccaaaatgttctcaagaggaatccgccagcggagtgagaggtggcgaatcgcatcccctttcgaggcagctagcggcagaatgtcaagaaactcctgatgggaatagattgacttcagccgcaggcgatggcggcgaagatgttgccgtacttctcgcagcacagtctcgtggcgatcgcggacaaagaagctgactttgaagggtgtttgatcctcttccggctgcagttcaagaaagggtagttgtgccattactgcccgaattcgctgaggattccagttgcgattgatatgcttttcccagctgatatccggttcagcatcggtgccatagtgaatctcgctgccgacggaagtcacccagaagtttggcgaaggaacgccccactctttcaagacttcttgggcagagtctaggcgacgccccgtggcaattccaaaggcaaaatgatcgcgatactgatcgagataggtcattaaattctcgagtccttgacgatcgcccaacagtgtgttgtcgatgtcactaacgacaaggcgtttggcatcaatcaagcgtttgcgactccgtacgaaactgacagcacgacgacgaggcaaagccaccgtttccatgcgctcaaacagggtattgacatgttgatcccagctgtaatgggcgggaactttttcaatgccattgcggtgatagcactgccaaagatcgcgatcgctcagcagggtggcgagtgcagtcgcgatattagcgggtcggctgacatcaactaaagtgccgaaatcacagtgtttgagaatttcctgggggccgccatcatgggttgccaccaccggcacgccgcagcttcctgcctccaaaattgtcaaaccaaaaggttcggtcagcgccggattgacgaataccccgccggaatgagccgctaggcgatagaactccggcacatcatcagcctgatgctgtttgggataggcgacgctgccgtagaggtcgtagcgatcgaccagatggaaaatctcttggaacacctgccgactgccgcgatccatctggttgatgtcttggcggctgcccagtactaagacaaggttggcttttttgcgcagccaaggatgttcgccaaaggctcgcaccagcgccggtacatttttgcgaggtgcggggcgacagaggcagagaatttgaggtttttctgggtcgcgcagaaagcggctcagttcctgttggagaacaacaccgcgatcgcccaagggctgaaacctgaagcgatcggtatcgacacccggtggaatgacaagcttgcgctctgggttgtagcgatcgtaaacgcggtattgctcctccacttcctgctgagtgctggcgacaatccagtcagcatgagtgagcgtcatctcctccgcatcaattcgctgttgaatattgaattgcgcttcaatttcctcaagcggccagtcttgctccaacagcttttttagcttgatccgccccagagaatgccctgtgaaaattagcggtacattcaaccagcgactcagcagtgatcccacttggccagcatcagcatagtgggcctgaatccaagtcggggtgcgcttttgctgagccagatattggagaattgcatccgcaaaggtgtagagatggggccaaagcagctctttacggaggtagcgtttggggccaaaaggcaaacggacaatccgacctttgggcgcaaagggttcgatcgcctgactgtaaccaacactgacgcgggggtcggtgatttggcgggtgatgatgtcgacttgttggacttgtggggatttagcttgggcttgagccagttctaagacgtacttggtctgcccgccggtgtcggcatctcgccccagttccaagttctgccctcgcagcagaccatgggtctgaatgtgcagaatgtagagattttgagctgccatatggatccttccaaggcacaccacgtaatttgtaacttgtctcacaatatatcaagaaatggcataagttattctttgaaagttcttaacttacatatttaaatttgttattacataaagttttaaacgttttgttaacaatcagttacaaaatgtatcaatgactgtataggagtcagttgtcagttgccaatagtcattggtcaatagtccatagtcattcttctttacttcccctgcctcctctacttatcctctgccccctgccttttcccaatccccaatccccatatgtttaaaaaatcccaactaagggaagactgagattaacctttggtcagtttcgctaatggctggagcctgcaggcatgcaaaaaagcccctgcccaaaggcaggagctgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaagtcgtcgacgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatg

SEQ ID NO: 241 - DNA, 3144 bp, Artificial Sequence
  contains chloramphenicol acetyltransferase gene
agattgcagcattacacgtcttgagcgattgtgtaggctggagctgcttcgaagttcctatactttctagagaataggaacttcggaataggaacttcatttaaatggcgcgccttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgtaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacaactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtaggcgcgccgaagttcctatactttctagagaataggaacttcgaactgcaggtcgacggatccccggaattaattctcatgtttgacagcttatcactgatcagtgaattaatggcgatgacgcatcctcacgataatatccgggtaggcgcaatcactttcgtctctactccgttacaaagcgaggctgggtatttcccggcctttctgttatccgaaatccactgaaagcacagcggctggctgaggagataaataataaacgaggggctgtatgcacaaagcatcttctgttgagttaagaacgagtatcgagatggcacatagccttgctcaaattggaatcaggtttgtgccaataccagtagaaacagacgaagaagctagctttgcactggattgcgaggctttgccatggctaattcccatgtcagccgttaagtgttcctgtgtcactgaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgcggatcttgcggccgcaaaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgcatcgatggccccccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtggccagtgccaagcttgcatgc

SEQ ID NO: 242 - DNA, 36 bp, Artificial Sequence
  primer
taattcccgcggcagtgataagctgtcaaacatgag

SEQ ID NO: 243 - DNA, 33 bp, Artificial Sequence
  primer
ttgcatccgcggtgcagcattacacgtcttgag

SEQ ID NO: 244 - DNA, 6754 bp, Artificial Sequence
  plasmid
gcggcgccgtcgacctgcaggcatgcaaaaaagcccctgcccaaaggcaggagctgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaagtcgtcgacgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctgctagagaattcgtcgacgagctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatgggtaccgcggtgcagcattacacgtcttgagcgattgtgtaggctggagctgcttcgaagttcctatactttctagagaataggaacttcggaataggaacttcatttaaatggcgcgccttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgtaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacaactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtaggcgcgccgaagttcctatactttctagagaataggaacttcgaactgcaggtcgacggatccccggaattaattctcatgtttgacagcttatcactgcc

SEQ ID NO: 245 - DNA, 9572 bp, Artificial Sequence
  plasmid
ctagagaattcgtcgacgagctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatgggtaccgcggtgcagcattacacgtcttgagcgattgtgtaggctggagctgcttcgaagttcctatactttctagagaataggaacttcggaataggaacttcatttaaatggcgcgccttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgtaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacaactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtaggcgcgccgaagttcctatactttctagagaataggaacttcgaactgcaggtcgacggatccccggaattaattctcatgtttgacagcttatcactgccgcggcccgatttaatgatggtgatggtgatggctagaagcgatcgcctcaaaaaagcgatagtgttttaaggcttccagaatgccattagcatagtggccctcagcaaaatagacgcgctcgtagctgcgcagtggctccaattccggtgagtaattgccaactacaacgccgagattatggcccttgagcatttcctcatcgttaccagaatcgcctgccaccaaaatgttctcaagaggaatccgccagcggagtgagaggtggcgaatcgcatcccctttcgaggcagctagcggcagaatgtcaagaaactcctgatgggaatagattgacttcagccgcaggcgatggcggcgaagatgttgccgtacttctcgcagcacagtctcgtggcgatcgcggacaaagaagctgactttgaagggtgtttgatcctcttccggctgcagttcaagaaagggtagttgtgccattactgcccgaattcgctgaggattccagttgcgattgatatgcttttcccagctgatatccggttcagcatcggtgccatagtgaatctcgctgccgacggaagtcacccagaagtttggcgaaggaacgccccactctttcaagacttcttgggcagagtctaggcgacgccccgtggcaattccaaaggcaaaatgatcgcgatactgatcgagataggtcattaaattctcgagtccttgacgatcgcccaacagtgtgttgtcgatgtcactaacgacaaggcgtttggcatcaatcaagcgtttgcgactccgtacgaaactgacagcacgacgacgaggcaaagccaccgtttccatgcgctcaaacagggtattgacatgttgatcccagctgtaatgggcgggaactttttcaatgccattgcggtgatagcactgccaaagatcgcgatcgctcagcagggtggcgagtgcagtcgcgatattagcgggtcggctgacatcaactaaagtgccgaaatcacagtgtttgagaatttcctgggggccgccatcatgggttgccaccaccggcacgccgcagcttcctgcctccaaaattgtcaaaccaaaaggttcggtcagcgccggattgacgaataccccgccggaatgagccgctaggcgatagaactccggcacatcatcagcctgatgctgtttgggataggcgacgctgccgtagaggtcgtagcgatcgaccagatggaaaatctcttggaacacctgccgactgccgcgatccatctggttgatgtcttggcggctgcccagtactaagacaaggttggcttttttgcgcagccaaggatgttcgccaaaggctcgcaccagcgccggtacatttttgcgaggtgcggggcgacagaggcagagaatttgaggtttttctgggtcgcgcagaaagcggctcagttcctgttggagaacaacaccgcgatcgcccaagggctgaaacctgaagcgatcggtatcgacacccggtggaatgacaagcttgcgctctgggttgtagcgatcgtaaacgcggtattgctcctccacttcctgctgagtgctggcgacaatccagtcagcatgagtgagcgtcatctcctccgcatcaattcgctgttgaatattgaattgcgcttcaatttcctcaagcggccagtcttgctccaacagcttttttagcttgatccgccccagagaatgccctgtgaaaattagcggtacattcaaccagcgactcagcagtgatcccacttggccagcatcagcatagtgggcctgaatccaagtcggggtgcgcttttgctgagccagatattggagaattgcatccgcaaaggtgtagagatggggccaaagcagctctttacggaggtagcgtttggggccaaaaggcaaacggacaatccgacctttgggcgcaaagggttcgatcgcctgactgtaaccaacactgacgcgggggtcggtgatttggcgggtgatgatgtcgacttgttggacttgtggggatttagcttgggcttgagccagttctaagacgtacttggtctgcccgccggtgtcggcatctcgccccagttccaagttctgccctcgcagcagaccatgggtctgaatgtgcagaatgtagagattttgagctgccatatggatccttccaagatgtcactctttttacttatcaaatcacgttttggtacaatttcctctcacaattgccctacctccctatcagccaggagaaaaacaggaataatcttttggtagaggtcagcgacctttctgcaactaacacttagctttagtggtaatcctcttcaccagtgtcttgctcatctaggagtgcataagttaacgcttttactttttcctcttgccatagttaaaaaattcttttttatctgttcttctcacccactaaattgcttttatcccttcacgaccttcgcggtttacggaaagtatgagatgattcccctatatttcggggtatttaatgaattgggttagttttcacacattcccgcttctgcactcttgccgacctcctttattgacaggagacgagctaagagccaatttacttgacggatatttagtagagtaatcagcgcaagatgaaaaaattgcacaccacgtaatttgtaacttgtctcacaatatatcaagaaatggcataagttattctttgaaagttcttaacttacatatttaaatttgttattacataaagttttaaacgttttgttaacaatcagttacaaaatgtatcaatgactgtataggagtcagttgtcagttgccaatagtcattcctgcaggcatgcaaaaaagcccctgcccaaaggcaggagctgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaagtcgtcgacgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctg

SEQ ID NO: 246 - DNA, 9264 bp, Artificial Sequence
  plasmid
ctagagaattcgtcgacgagctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatgggtaccgcggtgcagcattacacgtcttgagcgattgtgtaggctggagctgcttcgaagttcctatactttctagagaataggaacttcggaataggaacttcatttaaatggcgcgccttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgtaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacaactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtaggcgcgccgaagttcctatactttctagagaataggaacttcgaactgcaggtcgacggatccccggaattaattctcatgtttgacagcttatcactgccgcggcccgatttaatgatggtgatggtgatggctagaagcgatcgcctcaaaaaagcgatagtgttttaaggcttccagaatgccattagcatagtggccctcagcaaaatagacgcgctcgtagctgcgcagtggctccaattccggtgagtaattgccaactacaacgccgagattatggcccttgagcatttcctcatcgttaccagaatcgcctgccaccaaaatgttctcaagaggaatccgccagcggagtgagaggtggcgaatcgcatcccctttcgaggcagctagcggcagaatgtcaagaaactcctgatgggaatagattgacttcagccgcaggcgatggcggcgaagatgttgccgtacttctcgcagcacagtctcgtggcgatcgcggacaaagaagctgactttgaagggtgtttgatcctcttccggctgcagttcaagaaagggtagttgtgccattactgcccgaattcgctgaggattccagttgcgattgatatgcttttcccagctgatatccggttcagcatcggtgccatagtgaatctcgctgccgacggaagtcacccagaagtttggcgaaggaacgccccactctttcaagacttcttgggcagagtctaggcgacgccccgtggcaattccaaaggcaaaatgatcgcgatactgatcgagataggtcattaaattctcgagtccttgacgatcgcccaacagtgtgttgtcgatgtcactaacgacaaggcgtttggcatcaatcaagcgtttgcgactccgtacgaaactgacagcacgacgacgaggcaaagccaccgtttccatgcgctcaaacagggtattgacatgttgatcccagctgtaatgggcgggaactttttcaatgccattgcggtgatagcactgccaaagatcgcgatcgctcagcagggtggcgagtgcagtcgcgatattagcgggtcggctgacatcaactaaagtgccgaaatcacagtgtttgagaatttcctgggggccgccatcatgggttgccaccaccggcacgccgcagcttcctgcctccaaaattgtcaaaccaaaaggttcggtcagcgccggattgacgaataccccgccggaatgagccgctaggcgatagaactccggcacatcatcagcctgatgctgtttgggataggcgacgctgccgtagaggtcgtagcgatcgaccagatggaaaatctcttggaacacctgccgactgccgcgatccatctggttgatgtcttggcggctgcccagtactaagacaaggttggcttttttgcgcagccaaggatgttcgccaaaggctcgcaccagcgccggtacatttttgcgaggtgcggggcgacagaggcagagaatttgaggtttttctgggtcgcgcagaaagcggctcagttcctgttggagaacaacaccgcgatcgcccaagggctgaaacctgaagcgatcggtatcgacacccggtggaatgacaagcttgcgctctgggttgtagcgatcgtaaacgcggtattgctcctccacttcctgctgagtgctggcgacaatccagtcagcatgagtgagcgtcatctcctccgcatcaattcgctgttgaatattgaattgcgcttcaatttcctcaagcggccagtcttgctccaacagcttttttagcttgatccgccccagagaatgccctgtgaaaattagcggtacattcaaccagcgactcagcagtgatcccacttggccagcatcagcatagtgggcctgaatccaagtcggggtgcgcttttgctgagccagatattggagaattgcatccgcaaaggtgtagagatggggccaaagcagctctttacggaggtagcgtttggggccaaaaggcaaacggacaatccgacctttgggcgcaaagggttcgatcgcctgactgtaaccaacactgacgcgggggtcggtgatttggcgggtgatgatgtcgacttgttggacttgtggggatttagcttgggcttgagccagttctaagacgtacttggtctgcccgccggtgtcggcatctcgccccagttccaagttctgccctcgcagcagaccatgggtctgaatgtgcagaatgtagagattttgagctgccatatggatccttccaaggcacaccacgtaatttgtaacttgtctcacaatatatcaagaaatggcataagttattctttgaaagttcttaacttacatatttaaatttgttattacataaagttttaaacgttttgttaacaatcagttacaaaatgtatcaatgactgtataggagtcagttgtcagttgccaatagtcattggtcaatagtccatagtcattcttctttacttcccctgcctcctctacttatcctctgccccctgccttttcccaatccccaatccccatatgtttaaaaaatcccaactaagggaagactgagattaacctttggtcagtttcgctaatggctggagcctgcaggcatgcaaaaaagcccctgcccaaaggcaggagctgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaagtcgtcgacgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctg

SEQ ID NO: 247 - DNA, 6275 bp, Artificial Sequence
  plasmid
gaattccacctatgtccagctcatccatgcccccttggaaccctgcgaactggccttggacaatggacagtggtacgatcgccagaagatccgtcaccagttgcccgctagcaaaaccattgattgcctgttagtagatggaccgcccgcctaccgagaagacattcaatattcccggtttcctgcagtgccttttttccaaccgcaattggcaccccacagcaccatcattttggatgacattaaccgtaggggagaacaggaaattttagcccgttggcaaacattgctcaatgttagttttgatagctccattggcaatgtggcgatcgcccatctgtcggcctagggtaaattttaaaaatcccctgatccaccagtttcagggaaagccgggtaaaaatctgccagtgttgggatattggatattgagggaacgagctagaaccctactatctgtcagcctagcaaaccaaatgctttacatcgtcagactagttcaggaaaattaagtttgacccatagattaatcctaatcttttgctatgaaatccccccaggctcaacaaatcctagaccaggcccgccgtttgctctacgaaaaagccatggtcgcatgcctgcaggcccgcggtacccaggtgctttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccatttattttttgcccaattcctgggaacggcgataggccgcccgcactgcttcgatgatggcggaacgaaaacccatcttctccaataccgctaccccagcaatggtggtgccccccggactggtaactttatctttaatctgggcagggtgctcctccgtttccttgattaactccgctgtgcccaacactgtttgcaaagccaatttttgggcgatcgccctgggtaatccggccaaaacaccaccatcggccagggcttcgatcatcaaagctacgtaggccggtcccgaaccggaaacccccgtcaccgcatccattaaattttccggcacctccaccacattgcccaccgccgaaaagatggccttagccttagccaactgatccggctccaccattttattcgcggcgatcgccgtcataccggccccaacggtggcgggggtattgggcatggcccggatgatggcatggtcgggaaaacccttttgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctgctaga

SEQ ID NO: 248 - DNA, 35 bp, Artificial Sequence
  primer
ggaagagaattccacctatgtccagctcatccatg

SEQ ID NO: 249 - DNA, 72 bp, Artificial Sequence
  primer
caaacggcgcaaaaagcacctgggtaccgcgggcctgcaggcatgcgaccatggctttttcgtagagcaaac

SEQ ID NO: 250 - DNA, 38 bp, Artificial Sequence
  primer
ccgggtgaattccagtttagcaggaggagccaatcgtc

SEQ ID NO: 251 - DNA, 36 bp, Artificial Sequence; identical to SEQ ID NO: 199
  primer

SEQ ID NO: 252 - DNA, 32 bp, Artificial Sequence; identical to SEQ ID NO: 200
  primer

SEQ ID NO: 253 - DNA, 6308 bp, Artificial Sequence
  plasmid
ctagagaattccacctatgtccagctcatccatgcccccttggaaccctgcgaactggccttggacaatggacagtggtacgatcgccagaagatccgtcaccagttgcccgctagcaaaaccattgattgcctgttagtagatggaccgcccgcctaccgagaagacattcaatattcccggtttcctgcagtgccttttttccaaccgcaattggcaccccacagcaccatcattttggatgacattaaccgtaggggagaacaggaaattttagcccgttggcaaacattgctcaatgttagttttgatagctccattggcaatgtggcgatcgcccatctgtcggcctagggtaaattttaaaaatcccctgatccaccagtttcagggaaagccgggtaaaaatctgccagtgttgggatattggatattgagggaacgagctagaaccctactatctgtcagcctagcaaaccaaatgctttacatcgtcagactagttcaggaaaattaagtttgacccatagattaatcctaatcttttgctatgaaatccccccaggctcaacaaatcctagaccaggcccgccgtttgctctacgaaaaagccatgcggccgcagctcctgcctttgggcaggggcttttttgcatgcctgcaggcccgcggtacccaggtgctttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccatttattttttgcccaattcctgggaacggcgataggccgcccgcactgcttcgatgatggcggaacgaaaacccatcttctccaataccgctaccccagcaatggtggtgccccccggactggtaactttatctttaatctgggcagggtgctcctccgtttccttgattaactccgctgtgcccaacactgtttgcaaagccaatttttgggcgatcgccctgggtaatccggccaaaacaccaccatcggccagggcttcgatcatcaaagctacgtaggccggtcccgaaccggaaacccccgtcaccgcatccattaaattttccggcacctccaccacattgcccaccgccgaaaagatggccttagccttagccaactgatccggctccaccattttattcgcggcgatcgccgtcataccggccccaacggtggcgggggtattgggcatggcccggatgatggcatggtcgggaaaacccttttgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctg

SEQ ID NO: 254 - DNA, 60 bp, Artificial Sequence
  primer
gtttaaacagtaggtgaaagggtctgggagtaatctcagaccctttccctttttaattaa

SEQ ID NO: 255 - DNA, 66 bp, Artificial Sequence
  primer
gatcttaattaaaaagggaaagggtctgagattactcccagaccctttcacctactgtttaaacgc

SEQ ID NO: 256 - DNA, 9593 bp, Artificial Sequence
  plasmid
ctagagaattcgtcgacgagctttttgagccatgactttactcctgttgttaacgtttgggggtgaatttgtaattatttgatcactagtttaatggtgttatcaagtaccaaagcaacgatcgcctgcatcccctaggccgggcacaatgtaaccccggtcattgagttgttcgtcaatcatggcggtgtagatggtcaaattgggatgggcattacttaatttttgcagggcagtgggggcggccaccacggagaccaaacggattaaattggcatcaatgtcccgggccatcagcaaatccaaagcagccatgatggtattacccgtagccaacatgggatctagcaacaaaagatgggtaccgcggtgcagcattacacgtcttgagcgattgtgtaggctggagctgcttcgaagttcctatactttctagagaataggaacttcggaataggaacttcatttaaatggcgcgccttacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacgtaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgacaactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtaggcgcgccgaagttcctatactttctagagaataggaacttcgaactgcaggtcgacggatcttaattaaaaagggaaagggtctgagattactcccagaccctttcacctactgtttaaacgcggcccgatttaatgatggtgatggtgatggctagaagcgatcgcctcaaaaaagcgatagtgttttaaggcttccagaatgccattagcatagtggccctcagcaaaatagacgcgctcgtagctgcgcagtggctccaattccggtgagtaattgccaactacaacgccgagattatggcccttgagcatttcctcatcgttaccagaatcgcctgccaccaaaatgttctcaagaggaatccgccagcggagtgagaggtggcgaatcgcatcccctttcgaggcagctagcggcagaatgtcaagaaactcctgatgggaatagattgacttcagccgcaggcgatggcggcgaagatgttgccgtacttctcgcagcacagtctcgtggcgatcgcggacaaagaagctgactttgaagggtgtttgatcctcttccggctgcagttcaagaaagggtagttgtgccattactgcccgaattcgctgaggattccagttgcgattgatatgcttttcccagctgatatccggttcagcatcggtgccatagtgaatctcgctgccgacggaagtcacccagaagtttggcgaaggaacgccccactctttcaagacttcttgggcagagtctaggcgacgccccgtggcaattccaaaggcaaaatgatcgcgatactgatcgagataggtcattaaattctcgagtccttgacgatcgcccaacagtgtgttgtcgatgtcactaacgacaaggcgtttggcatcaatcaagcgtttgcgactccgtacgaaactgacagcacgacgacgaggcaaagccaccgtttccatgcgctcaaacagggtattgacatgttgatcccagctgtaatgggcgggaactttttcaatgccattgcggtgatagcactgccaaagatcgcgatcgctcagcagggtggcgagtgcagtcgcgatattagcgggtcggctgacatcaactaaagtgccgaaatcacagtgtttgagaatttcctgggggccgccatcatgggttgccaccaccggcacgccgcagcttcctgcctccaaaattgtcaaaccaaaaggttcggtcagcgccggattgacgaataccccgccggaatgagccgctaggcgatagaactccggcacatcatcagcctgatgctgtttgggataggcgacgctgccgtagaggtcgtagcgatcgaccagatggaaaatctcttggaacacctgccgactgccgcgatccatctggttgatgtcttggcggctgcccagtactaagacaaggttggcttttttgcgcagccaaggatgttcgccaaaggctcgcaccagcgccggtacatttttgcgaggtgcggggcgacagaggcagagaatttgaggtttttctgggtcgcgcagaaagcggctcagttcctgttggagaacaacaccgcgatcgcccaagggctgaaacctgaagcgatcggtatcgacacccggtggaatgacaagcttgcgctctgggttgtagcgatcgtaaacgcggtattgctcctccacttcctgctgagtgctggcgacaatccagtcagcatgagtgagcgtcatctcctccgcatcaattcgctgttgaatattgaattgcgcttcaatttcctcaagcggccagtcttgctccaacagcttttttagcttgatccgccccagagaatgccctgtgaaaattagcggtacattcaaccagcgactcagcagtgatcccacttggccagcatcagcatagtgggcctgaatccaagtcggggtgcgcttttgctgagccagatattggagaattgcatccgcaaaggtgtagagatggggccaaagcagctctttacggaggtagcgtttggggccaaaaggcaaacggacaatccgacctttgggcgcaaagggttcgatcgcctgactgtaaccaacactgacgcgggggtcggtgatttggcgggtgatgatgtcgacttgttggacttgtggggatttagcttgggcttgagccagttctaagacgtacttggtctgcccgccggtgtcggcatctcgccccagttccaagttctgccctcgcagcagaccatgggtctgaatgtgcagaatgtagagattttgagctgccatatggatccttccaagatgtcactctttttacttatcaaatcacgttttggtacaatttcctctcacaattgccctacctccctatcagccaggagaaaaacaggaataatcttttggtagaggtcagcgacctttctgcaactaacacttagctttagtggtaatcctcttcaccagtgtcttgctcatctaggagtgcataagttaacgcttttactttttcctcttgccatagttaaaaaattcttttttatctgttcttctcacccactaaattgcttttatcccttcacgaccttcgcggtttacggaaagtatgagatgattcccctatatttcggggtatttaatgaattgggttagttttcacacattcccgcttctgcactcttgccgacctcctttattgacaggagacgagctaagagccaatttacttgacggatatttagtagagtaatcagcgcaagatgaaaaaattgcacaccacgtaatttgtaacttgtctcacaatatatcaagaaatggcataagttattctttgaaagttcttaacttacatatttaaatttgttattacataaagttttaaacgttttgttaacaatcagttacaaaatgtatcaatgactgtataggagtcagttgtcagttgccaatagtcattcctgcaggcatgcaaaaaagcccctgcccaaaggcaggagctgcgcactaaacccagatggtaaatttttgccaggggcaacaacccctgggccccttccaccagagccaaccccgcccgcaaaatgggcacaatgacaaagggcgtttgggggtcaataagactggccttggcgatcgccaggggagttttcacttccgtatccaccgtcggcaaccaataacgagcggcctcataggtcaaccaacgtcccaattcccccatggcagttttaaacaaaaccggcggcgtgttttcatccctagctacccccaaccaatgcttaattagaggatgctccggcacataaacacgtaattgagaagccatgggaaagtcgtcgacgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctg

SEQ ID NO: 257 - DNA, 10230 bp, Artificial Sequence
  plasmid
caggtgctttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccatttattttttgcccaattcctgggaacggcgataggccgcccgcactgcttcgatgatggcggaacgaaaacccatcttctccaataccgctaccccagcaatggtggtgccccccggactggtaactttatctttaatctgggcagggtgctcctccgtttccttgattaactccgctgtgcccaacactgtttgcaaagccaatttttgggcgatcgccctgggtaatccggccaaaacaccaccatcggccagggcttcgatcatcaaagctacgtaggccggtcccgaaccggaaacccccgtcaccgcatccattaaattttccggcacctccaccacattgcccaccgccgaaaagatggccttagccttagccaactgatccggctccaccattttattcgcggcgatcgccgtcataccggccccaacggtggcgggggtattgggcatggcccggatgatggcatggtcgggaaaacccttttgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctgctagagaattccacctatgtccagctcatccatgcccccttggaaccctgcgaactggccttggacaatggacagtggtacgatcgccagaagatccgtcaccagttgcccgctagcaaaaccattgattgcctgttagtagatggaccgcccgcctaccgagaagacattcaatattcccggtttcctgcagtgccttttttccaaccgcaattggcaccccacagcaccatcattttggatgacattaaccgtaggggagaacaggaaattttagcccgttggcaaacattgctcaatgttagttttgatagctccattggcaatgtggcgatcgcccatctgtcggcctagggtaaattttaaaaatcccctgatccaccagtttcagggaaagccgggtaaaaatctgccagtgttgggatattggatattgagggaacgagctagaaccctactatctgtcagcctagcaaaccaaatgctttacatcgtcagactagttcaggaaaattaagtttgacccatagattaatcctaatcttttgctatgaaatccccccaggctcaacaaatcctagaccaggcccgccgtttgctctacgaaaaagccatgcggccgcagctcctgcctttgggcaggggcttttttgcatgcctgcaggaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgcaattttttcatcttgcgctgattactctactaaatatccgtcaagtaaattggctcttagctcgtctcctgtcaataaaggaggtcggcaagagtgcagaagcgggaatgtgtgaaaactaacccaattcattaaataccccgaaatataggggaatcatctcatactttccgtaaaccgcgaaggtcgtgaagggataaaagcaatttagtgggtgagaagaacagataaaaaagaattttttaactatggcaagaggaaaaagtaaaagcgttaacttatgcactcctagatgagcaagacactggtgaagaggattaccactaaagctaagtgttagttgcagaaaggtcgctgacctctaccaaaagattattcctgtttttctcctggctgatagggaggtagggcaattgtgagaggaaattgtaccaaaacgtgatttgataagtaaaaagagtgacatcttggaaggatccatatggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttctagccatcaccatcaccatcattaaatcgggccgcgtttaaacagtaggtgaaagggtctgggagtaatctcagaccctttccctttttaattaagatccgtcgacctgcagttcgaagttcctattctctagaaagtataggaacttcggcgcgcctacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaggcgcgccatttaaatgaagttcctattccgaagttcctattctctagaaagtataggaacttcgaagcagctccagcctacacaatcgctcaagacgtgtaatgctgcaccgcggtacc

SEQ ID NO: 258 - DNA, 9922 bp, Artificial Sequence
  plasmid
caggtgctttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccatttattttttgcccaattcctgggaacggcgataggccgcccgcactgcttcgatgatggcggaacgaaaacccatcttctccaataccgctaccccagcaatggtggtgccccccggactggtaactttatctttaatctgggcagggtgctcctccgtttccttgattaactccgctgtgcccaacactgtttgcaaagccaatttttgggcgatcgccctgggtaatccggccaaaacaccaccatcggccagggcttcgatcatcaaagctacgtaggccggtcccgaaccggaaacccccgtcaccgcatccattaaattttccggcacctccaccacattgcccaccgccgaaaagatggccttagccttagccaactgatccggctccaccattttattcgcggcgatcgccgtcataccggccccaacggtggcgggggtattgggcatggcccggatgatggcatggtcgggaaaacccttttgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctgctagagaattccacctatgtccagctcatccatgcccccttggaaccctgcgaactggccttggacaatggacagtggtacgatcgccagaagatccgtcaccagttgcccgctagcaaaaccattgattgcctgttagtagatggaccgcccgcctaccgagaagacattcaatattcccggtttcctgcagtgccttttttccaaccgcaattggcaccccacagcaccatcattttggatgacattaaccgtaggggagaacaggaaattttagcccgttggcaaacattgctcaatgttagttttgatagctccattggcaatgtggcgatcgcccatctgtcggcctagggtaaattttaaaaatcccctgatccaccagtttcagggaaagccgggtaaaaatctgccagtgttgggatattggatattgagggaacgagctagaaccctactatctgtcagcctagcaaaccaaatgctttacatcgtcagactagttcaggaaaattaagtttgacccatagattaatcctaatcttttgctatgaaatccccccaggctcaacaaatcctagaccaggcccgccgtttgctctacgaaaaagccatgcggccgcagctcctgcctttgggcaggggcttttttgcatgcctgcaggctccagccattagcgaaactgaccaaaggttaatctcagtcttcccttagttgggattttttaaacatatggggattggggattgggaaaaggcagggggcagaggataagtagaggaggcaggggaagtaaagaagaatgactatggactattgaccaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgccttggaaggatccatatggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttctagccatcaccatcaccatcattaaatcgggccgcgtttaaacagtaggtgaaagggtctgggagtaatctcagaccctttccctttttaattaagatccgtcgacctgcagttcgaagttcctattctctagaaagtataggaacttcggcgcgcctacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaggcgcgccatttaaatgaagttcctattccgaagttcctattctctagaaagtataggaacttcgaagcagctccagcctacacaatcgctcaagacgtgtaatgctgcaccgcggtacc

SEQ ID NO: 259 - DNA, 38 bp, Artificial Sequence
  primer
gcaggagcggccgctagagtcagcacctgtttcagttg

SEQ ID NO: 260 - DNA, 47 bp, Artificial Sequence
  primer
tcggtagaattcgcgccggcggacgttggtagatcagcaatgtcttg

SEQ ID NO: 261 - DNA, 6362 bp, Artificial Sequence
  plasmid
ggccgcagctcctgcctttgggcaggggcttttttgcatgcctgcaggcccgcggtacccaggtgctttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccatttattttttgcccaattcctgggaacggcgataggccgcccgcactgcttcgatgatggcggaacgaaaacccatcttctccaataccgctaccccagcaatggtggtgccccccggactggtaactttatctttaatctgggcagggtgctcctccgtttccttgattaactccgctgtgcccaacactgtttgcaaagccaatttttgggcgatcgccctgggtaatccggccaaaacaccaccatcggccagggcttcgatcatcaaagctacgtaggccggtcccgaaccggaaacccccgtcaccgcatccattaaattttccggcacctccaccacattgcccaccgccgaaaagatggccttagccttagccaactgatccggctccaccattttattcgcggcgatcgccgtcataccggccccaacggtggcgggggtattgggcatggcccggatgatggcatggtcgggaaaacccttttgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctgctagagaattcgcgccggcggacgttggtagatcagcaatgtcttgccagtctaaatccaattgaaaacagatttccataaaaatattgcggtcaaccgggcgaccggtcaaaaacttccacacggaattacgggtggataaacccgcttcgatcgccaaatattcctgggtccagccccggcacaacatcgcctgcttggcttgggcttgcccatctggtgaagctttaagggaacgttttgccatgtttacaatgatagagaatttttggaacccattttcaagaagttagacattggcttaggcctaaacgtaaatatgggtgagagacagtagatataggcggttaaacggcaaccacgagttcacctaaacactgcctttgttctctaactccttggtgattacctatggctagcactattcaactgattgaagttccccaaagcttttgtcaacaggaagttgcatttattcagtcccaattggctgaatggtttgaggctgaggcgcaagtgggtcggctggtgttcgattttgctaagacccgtgtgttggacagtgcggcgatcgtttacctccgccaattgtcacaacaagcaaaggataaaggggttgaattattggggtggagtttacgcccgcaactgaaacaggtgctgactctagc

SEQ ID NO: 262 - DNA, 39 bp, Artificial Sequence
  primer
cctgcaggtaccagagatgatcgaatacagtctttatag

SEQ ID NO: 263 - DNA, 40 bp, Artificial Sequence
  primer
aagcttgaattcggtccgtccaattgaggactgatatctc

SEQ ID NO: 264 - DNA, 6700 bp, Artificial Sequence
  plasmid
aattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctgctagagaattcgcgccggcggacgttggtagatcagcaatgtcttgccagtctaaatccaattgaaaacagatttccataaaaatattgcggtcaaccgggcgaccggtcaaaaacttccacacggaattacgggtggataaacccgcttcgatcgccaaatattcctgggtccagccccggcacaacatcgcctgcttggcttgggcttgcccatctggtgaagctttaagggaacgttttgccatgtttacaatgatagagaatttttggaacccattttcaagaagttagacattggcttaggcctaaacgtaaatatgggtgagagacagtagatataggcggttaaacggcaaccacgagttcacctaaacactgcctttgttctctaactccttggtgattacctatggctagcactattcaactgattgaagttccccaaagcttttgtcaacaggaagttgcatttattcagtcccaattggctgaatggtttgaggctgaggcgcaagtgggtcggctggtgttcgattttgctaagacccgtgtgttggacagtgcggcgatcgtttacctccgccaattgtcacaacaagcaaaggataaaggggttgaattattggggtggagtttacgcccgcaactgaaacaggtgctgactctagcggccgcagctcctgcctttgggcaggggcttttttgcatgcctgcaggcccgcggtaccagagatgatcgaatacagtctttatagcaagcaattacaaccctactttgagcagtttggacgtgagcgggtgttacctgtcttttttgaacggatgttagcccattcccaggcagagttagaacgggtttgtaactttattggctatcaaggaactcccatttggcaagaattaaatccgcaaaatgtatccagcgatcgcatacgcatctcaggctggcgagactttttagtcgaagcaccgggattaaagcagctacgccgctggctaattcctaaatctttacgaacctggataagaagcctctggagtatgaaaaaacgtcctcaacttagcaacgaacggttagcatatctcaaaaaaatctttgatcaagacttgcaagtattaggctcttggctaggcattcccctagactgtaccacctttaaaacaacggtgaaaagccaaaattcggcgtggttcaaaagagatcaaatttaggtactacgggcacaataaattgaggtaggggtcgaacctagataagagtagaatagtgcaagatgacccttaaagccttatcctgtaagcattaagctgttgtcgctatacagggagtgatctgaattttgtgtaaggggagtaaaatccaatcaaaaggaggacacccctttatggtacaaaaaaacaagaagcaaattgtgtggataccttactagacgagttgctggaagagtatcaaaccccggaagaaatactgggagaatcaggactactaaaacaactaaccaaacgcttgatagagcgtgcattggctggggaactgagtcatcacttaaaaaatcaggcagaggaagagaagcgcaatagtcgcaacgggtactcaaagaaaacagtacagtcggagcaaggagaaatggaattggccatcccccgagaccggcagggaaaatttgagccagtgctagtgcccaaaaatgagcgtcgcatcgcgggattagatgagaaaatccttgctttgtatgcgcgtgggatgagtactcgagatatcagtcctcaattggacggaccg

SEQ ID NO: 265 - DNA, 10314 bp, Artificial Sequence
  plasmid
aattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctgctagagaattcgcgccggcggacgttggtagatcagcaatgtcttgccagtctaaatccaattgaaaacagatttccataaaaatattgcggtcaaccgggcgaccggtcaaaaacttccacacggaattacgggtggataaacccgcttcgatcgccaaatattcctgggtccagccccggcacaacatcgcctgcttggcttgggcttgcccatctggtgaagctttaagggaacgttttgccatgtttacaatgatagagaatttttggaacccattttcaagaagttagacattggcttaggcctaaacgtaaatatgggtgagagacagtagatataggcggttaaacggcaaccacgagttcacctaaacactgcctttgttctctaactccttggtgattacctatggctagcactattcaactgattgaagttccccaaagcttttgtcaacaggaagttgcatttattcagtcccaattggctgaatggtttgaggctgaggcgcaagtgggtcggctggtgttcgattttgctaagacccgtgtgttggacagtgcggcgatcgtttacctccgccaattgtcacaacaagcaaaggataaaggggttgaattattggggtggagtttacgcccgcaactgaaacaggtgctgactctagcggccgcagctcctgcctttgggcaggggcttttttgcatgcctgcaggctccagccattagcgaaactgaccaaaggttaatctcagtcttcccttagttgggattttttaaacatatggggattggggattgggaaaaggcagggggcagaggataagtagaggaggcaggggaagtaaagaagaatgactatggactattgaccaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgccttggaaggatccatatggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttctagccatcaccatcaccatcattaaatcgggccgcgtttaaacagtaggtgaaagggtctgggagtaatctcagaccctttccctttttaattaagatccgtcgacctgcagttcgaagttcctattctctagaaagtataggaacttcggcgcgcctacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaggcgcgccatttaaatgaagttcctattccgaagttcctattctctagaaagtataggaacttcgaagcagctccagcctacacaatcgctcaagacgtgtaatgctgcaccgcggtaccagagatgatcgaatacagtctttatagcaagcaattacaaccctactttgagcagtttggacgtgagcgggtgttacctgtcttttttgaacggatgttagcccattcccaggcagagttagaacgggtttgtaactttattggctatcaaggaactcccatttggcaagaattaaatccgcaaaatgtatccagcgatcgcatacgcatctcaggctggcgagactttttagtcgaagcaccgggattaaagcagctacgccgctggctaattcctaaatctttacgaacctggataagaagcctctggagtatgaaaaaacgtcctcaacttagcaacgaacggttagcatatctcaaaaaaatctttgatcaagacttgcaagtattaggctcttggctaggcattcccctagactgtaccacctttaaaacaacggtgaaaagccaaaattcggcgtggttcaaaagagatcaaatttaggtactacgggcacaataaattgaggtaggggtcgaacctagataagagtagaatagtgcaagatgacccttaaagccttatcctgtaagcattaagctgttgtcgctatacagggagtgatctgaattttgtgtaaggggagtaaaatccaatcaaaaggaggacacccctttatggtacaaaaaaacaagaagcaaattgtgtggataccttactagacgagttgctggaagagtatcaaaccccggaagaaatactgggagaatcaggactactaaaacaactaaccaaacgcttgatagagcgtgcattggctggggaactgagtcatcacttaaaaaatcaggcagaggaagagaagcgcaatagtcgcaacgggtactcaaagaaaacagtacagtcggagcaaggagaaatggaattggccatcccccgagaccggcagggaaaatttgagccagtgctagtgcccaaaaatgagcgtcgcatcgcgggattagatgagaaaatccttgctttgtatgcgcgtgggatgagtactcgagatatcagtcctcaattggacggaccg

SEQ ID NO: 266 - DNA, 37 bp, Artificial Sequence
  primer
ggggaaggtaccgtaaataccatcatttcctttggtc

SEQ ID NO: 267 - DNA, 41 bp, Artificial Sequence
  primer
taaccacggtccggagcctggagtacgatccagttatctac

SEQ ID NO: 268 - DNA, 6960 bp, Artificial Sequence
  plasmid
gaccgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctgctagagaattcgcgccggcggacgttggtagatcagcaatgtcttgccagtctaaatccaattgaaaacagatttccataaaaatattgcggtcaaccgggcgaccggtcaaaaacttccacacggaattacgggtggataaacccgcttcgatcgccaaatattcctgggtccagccccggcacaacatcgcctgcttggcttgggcttgcccatctggtgaagctttaagggaacgttttgccatgtttacaatgatagagaatttttggaacccattttcaagaagttagacattggcttaggcctaaacgtaaatatgggtgagagacagtagatataggcggttaaacggcaaccacgagttcacctaaacactgcctttgttctctaactccttggtgattacctatggctagcactattcaactgattgaagttccccaaagcttttgtcaacaggaagttgcatttattcagtcccaattggctgaatggtttgaggctgaggcgcaagtgggtcggctggtgttcgattttgctaagacccgtgtgttggacagtgcggcgatcgtttacctccgccaattgtcacaacaagcaaaggataaaggggttgaattattggggtggagtttacgcccgcaactgaaacaggtgctgactctagcggccgcagctcctgcctttgggcaggggcttttttgcatgcctgcaggcccgcggtaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttaaccagccgaaatcatcgagaacagttaaaaatagcttaaaaatggctatctacctcaaacttcggtaatccctggcgatagctttttaattccccactccgggggccataaactccttcaatctgttcttcacagcaatggctagcaaattcgtcgaactccgccggagcaatgccaaacatccgggcaaagttatctggtttcacccggcaaaaactgggcctatcttcgtaaatctggcagaggcgatcgccgtggttgtaattaacgcaccaaccgtctgcccccactaggctgtggtagagggttaactcctccggggcgagatactcggccaactccggccggtcttctggggtgagattacaacaagcgccacatccctgcatgcaataccaagttgccatggccggtctccttcttcacataactttatgtatttttatgacggcaagtccaggggacgaaaccaacccagctattatagacattggttttattatccttgcttacgttgagtctagccagcagtttttaacaggagaaattatggaattattagccgcactcaatttagaacctatttttcagttgacttttttgggcctgattgttcttgctgggccggcggtggtgtttgtgctagccttccgaggcggcgatctatagactatgccagcctgacctattgtggcgagaaaccttcctgtggggaggtttttttatgtcccataacaacaacatagctaaaatggaggcagggacaatcatttgggaatatgccaagcaaatacccgaatctctcaacttcccgaattaacagaatctaccaatccatcctagggcgccgacaagccgatgttcaccaccacttcctttcctgactttgatagtgcggcccaggcaacattgacctatttacatcaacgaatggggctatccctgtggatgatcacccgcaccgaggtagataactggatcgtactccaggctccg

SEQ ID NO: 269 - DNA, 38 bp, Artificial Sequence
  primer
agcgatcgccggcgaagttgaggaataccctgaatctg

SEQ ID NO: 270 - DNA, 37 bp, Artificial Sequence
  primer
ccaagggcggccgcagttccagcacatatttggtttg

SEQ ID NO: 271 - DNA, 7228 bp, Artificial Sequence
  plasmid
ctagagaattcgcgccggcgaagttgaggaataccctgaatctgtttcaaaataatgggttgtaagcctgggaaccggcaatactcactccacggtgaagcttgtgcacactggagaactacctagggggtaatggcttgtaggtagggcgcaatataatttttcccccgcaggacaaaatggggtgtaagtagaggactgaattcttgttccactagatcttgggcttggttgaggcgatcgccgccataggcaatgaattgggcggtggaataggcgtaatattcttgtttggcagtttgattattttgtttgaaagcttggcgataaagctgggttgtctgctcgattaattgttcgatcgccggggtgaaagcaataattttgccactgggacaggcaatttttttaactttaataaaaccaattaccgtttgcatacattccctggtttgttccaccgataaacaatgttcgtcttggcgacggaaagcccactgcaaacagccattagagacttccagtacccgcaaaactgctaagttgtctaattcttcaggggcgatcgccgctaatccgggcaaatgttgttcaatttgttgctgaaagccagcaacatcttcggcaaaatagggctgtaactcagagattgcggccagggcctgccagttaacataggtcatcggaacatttgggacgaagattgggggcattctaacagaactgggagaaaacattgattaattgcaggcgttaaaatcgtcgccatggtaccctgtgacattcctcaacagcaattatagtaatttgtaaaacttatgagctattcatcaaaatacattttactaattagtgtccatggtttaattcggggagaaaaccttgagttgggcagagatgccgacaccggcgggcaaaccaaatatgtgctggaactgcggccgcagctcctgcctttgggcaggggcttttttgcatgcctgcaggcccgcggtaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttaaccagccgaaatcatcgagaacagttaaaaatagcttaaaaatggctatctacctcaaacttcggtaatccctggcgatagctttttaattccccactccgggggccataaactccttcaatctgttcttcacagcaatggctagcaaattcgtcgaactccgccggagcaatgccaaacatccgggcaaagttatctggtttcacccggcaaaaactgggcctatcttcgtaaatctggcagaggcgatcgccgtggttgtaattaacgcaccaaccgtctgcccccactaggctgtggtagagggttaactcctccggggcgagatactcggccaactccggccggtcttctggggtgagattacaacaagcgccacatccctgcatgcaataccaagttgccatggccggtctccttcttcacataactttatgtatttttatgacggcaagtccaggggacgaaaccaacccagctattatagacattggttttattatccttgcttacgttgagtctagccagcagtttttaacaggagaaattatggaattattagccgcactcaatttagaacctatttttcagttgacttttttgggcctgattgttcttgctgggccggcggtggtgtttgtgctagccttccgaggcggcgatctatagactatgccagcctgacctattgtggcgagaaaccttcctgtggggaggtttttttatgtcccataacaacaacatagctaaaatggaggcagggacaatcatttgggaatatgccaagcaaatacccgaatctctcaacttcccgaattaacagaatctaccaatccatcctagggcgccgacaagccgatgttcaccaccacttcctttcctgactttgatagtgcggcccaggcaacattgacctatttacatcaacgaatggggctatccctgtggatgatcacccgcaccgaggtagataactggatcgtactccaggctccggaccgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctg

SEQ ID NO: 272 - DNA, 10456 bp, Artificial Sequence
  plasmid
gcggtaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttaaccagccgaaatcatcgagaacagttaaaaatagcttaaaaatggctatctacctcaaacttcggtaatccctggcgatagctttttaattccccactccgggggccataaactccttcaatctgttcttcacagcaatggctagcaaattcgtcgaactccgccggagcaatgccaaacatccgggcaaagttatctggtttcacccggcaaaaactgggcctatcttcgtaaatctggcagaggcgatcgccgtggttgtaattaacgcaccaaccgtctgcccccactaggctgtggtagagggttaactcctccggggcgagatactcggccaactccggccggtcttctggggtgagattacaacaagcgccacatccctgcatgcaataccaagttgccatggccggtctccttcttcacataactttatgtatttttatgacggcaagtccaggggacgaaaccaacccagctattatagacattggttttattatccttgcttacgttgagtctagccagcagtttttaacaggagaaattatggaattattagccgcactcaatttagaacctatttttcagttgacttttttgggcctgattgttcttgctgggccggcggtggtgtttgtgctagccttccgaggcggcgatctatagactatgccagcctgacctattgtggcgagaaaccttcctgtggggaggtttttttatgtcccataacaacaacatagctaaaatggaggcagggacaatcatttgggaatatgccaagcaaatacccgaatctctcaacttcccgaattaacagaatctaccaatccatcctagggcgccgacaagccgatgttcaccaccacttcctttcctgactttgatagtgcggcccaggcaacattgacctatttacatcaacgaatggggctatccctgtggatgatcacccgcaccgaggtagataactggatcgtactccaggctccggaccgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctgctagagaattcgcgccggcgaagttgaggaataccctgaatctgtttcaaaataatgggttgtaagcctgggaaccggcaatactcactccacggtgaagcttgtgcacactggagaactacctagggggtaatggcttgtaggtagggcgcaatataatttttcccccgcaggacaaaatggggtgtaagtagaggactgaattcttgttccactagatcttgggcttggttgaggcgatcgccgccataggcaatgaattgggcggtggaataggcgtaatattcttgtttggcagtttgattattttgtttgaaagcttggcgataaagctgggttgtctgctcgattaattgttcgatcgccggggtgaaagcaataattttgccactgggacaggcaatttttttaactttaataaaaccaattaccgtttgcatacattccctggtttgttccaccgataaacaatgttcgtcttggcgacggaaagcccactgcaaacagccattagagacttccagtacccgcaaaactgctaagttgtctaattcttcaggggcgatcgccgctaatccgggcaaatgttgttcaatttgttgctgaaagccagcaacatcttcggcaaaatagggctgtaactcagagattgcggccagggcctgccagttaacataggtcatcggaacatttgggacgaagattgggggcattctaacagaactgggagaaaacattgattaattgcaggcgttaaaatcgtcgccatggtaccctgtgacattcctcaacagcaattatagtaatttgtaaaacttatgagctattcatcaaaatacattttactaattagtgtccatggtttaattcggggagaaaaccttgagttgggcagagatgccgacaccggcgggcaaaccaaatatgtgctggaactgcggccgcagctcctgcctttgggcaggggcttttttgcatgcctgcaggacttcattgatccttgcctataccatcaatatcattggtcaataatgatgatgattgactaaaacatgtttaacaaaatttaacgcatatgctaaatgcgtaaactgcatatgccttggctgagtgtaatttacgttacaaattttaacgaaacgggaaccctatattgatctctactcgcggagttataaggcacggttgcgatgctggccaacgaaaattctctgctgacgatgttccgggagttgggaagcggtaagctgcccctccagattgagcagtttgagcggggtaagaccatctttttcccgggggatccggctgaacgggtctacctgcttgtcaaaggagcggtcaagctctcacgagtctatgagtcgggcgaagaaattacggtggccctgctgcgtgagaacagcgtgtttggagtgctgtcgctgctgacaggtcagcgctccgatcgcttctaccatgcagtggcctttacgccggttcaactgttttcggtgccgatcgagttcatgcagaaggcgctgatcgaacggccggaactggccaacgtgatgctgcaggggctgtcctcgcggattctgcagaccgaaatgatgatcgagacgcttgcgcaccgcgatatgggttctcgcttggtcagctttttgctgattctctgtcgcgactttggcatccccagccctgatggcatcaccatcgatctcaagctttcccaccaggcaattgcggaagcgatcggctcaacgcgggtgacagtgacgcgcttgctgggtgacctacgggaatcaaaactgattgcgattcacaaaaagcggatcacggtctttaatccggtggcgctgagtcagcagttcagctaaatctcatgattaaggagtgggaagggtcgccatgcgcctagaacagctccaagccgcgctgcgggtggcggaaaccggaagttttcaagaagcagcccaaaaagtcggctgtaatcaatccacgatcagtcgccaagtcaagggattggaagatgagctagggattgccctgtttcggcgtcaggggcggatgaaactgacggcagcaggtgagcgtttactgccacggctgcgtcgcatttgccaagagtggcaaaccgcttgcactgaaattgaagagttgctgacggggcgtcaaaccgaattatgcatggcgatcgcagactcgatcggcggctgctatctgcccgctgtcctcaaccggtttcagcagcagtggccctccattcatttgcgcgtaagtacccttggcagcgatcgcgcgctgaaagtgctgcgggatggcttgattgatttggcgatcgtgatggactcgcccactttgaccactagtgccggtctcgtggtggatttgctgctcgaagaggaagtgcaggttctgctctccgttgatcatcctcttgctgaccaaaaggcgatcgcgtgggagcaactcagtcatgtcccccaagttgtctttaaggatggctacgggatgcagcgcttggtcgagcagcgctttcgagagttggggttagagctgaatagttgtctcgaactcaactcccttgacagctttcggggggtggtgcgagaaggctactggctggcgctgttaccgcaagccgccttggtcgatgcccgacatgatccgcgccttgtgattcgccctactgcagaaccgcgcctgactcgtcgcatcaagctggtcattcctgaggagcaactcagtctgccgccggtgcgccattttcgtcagctctgccgcgaagcgatgaccgctgaattatgtgattttaagacgttgagccaactgttctagctcggtgcgatcgcgtttaaacagtaggtgaaagggtctgggagtaatctcagaccctttccctttttaattaagatccgtcgacctgcagttcgaagttcctattctctagaaagtataggaacttcagagcgcttttgaagctcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaataaggggatcttgaagttcctattccgaagttcctattctctagaaagtataggaacttcgaagcagctccagcctacacaatcgctcaagacgtgtaatgctgcacc

SEQ ID NO: 273 - DNA, 10294 bp, Artificial Sequence
  plasmid
gcggtaccgtaaataccatcatttcctttggtcaatttttggatattctgcccatccgagcttccaaaggctatgctgtgcgttggttgagccaacagtggaatattcccctggagcacgttttcaccgccggaggatcgggagccgacgaagatatgatgcggggtaacaccctttccgtcgtcgtggctaaccgtcaccatgaggaactttctaatctaggggagatcgaaccgatttatttttccgaaaaacgttacgccgccggtattctggacggtctggcccattaccgcttctttgagttgttagaccccgtttaaccagccgaaatcatcgagaacagttaaaaatagcttaaaaatggctatctacctcaaacttcggtaatccctggcgatagctttttaattccccactccgggggccataaactccttcaatctgttcttcacagcaatggctagcaaattcgtcgaactccgccggagcaatgccaaacatccgggcaaagttatctggtttcacccggcaaaaactgggcctatcttcgtaaatctggcagaggcgatcgccgtggttgtaattaacgcaccaaccgtctgcccccactaggctgtggtagagggttaactcctccggggcgagatactcggccaactccggccggtcttctggggtgagattacaacaagcgccacatccctgcatgcaataccaagttgccatggccggtctccttcttcacataactttatgtatttttatgacggcaagtccaggggacgaaaccaacccagctattatagacattggttttattatccttgcttacgttgagtctagccagcagtttttaacaggagaaattatggaattattagccgcactcaatttagaacctatttttcagttgacttttttgggcctgattgttcttgctgggccggcggtggtgtttgtgctagccttccgaggcggcgatctatagactatgccagcctgacctattgtggcgagaaaccttcctgtggggaggtttttttatgtcccataacaacaacatagctaaaatggaggcagggacaatcatttgggaatatgccaagcaaatacccgaatctctcaacttcccgaattaacagaatctaccaatccatcctagggcgccgacaagccgatgttcaccaccacttcctttcctgactttgatagtgcggcccaggcaacattgacctatttacatcaacgaatggggctatccctgtggatgatcacccgcaccgaggtagataactggatcgtactccaggctccggaccgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtttaatgaccagcacagtcgtgatggcaaggtcagaatagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccacgttgtgtctcaaaatctctgatgttacattgcacaagataaaaatatatcatcatgaacaataaaactgtctgcttacataaacagtaatacaaggggtgttatgagccatattcaacgggaaacgtcttgctcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctattctgaccttgccatcacgactgtgctggtcattaaacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctgctagagaattcgcgccggcgaagttgaggaataccctgaatctgtttcaaaataatgggttgtaagcctgggaaccggcaatactcactccacggtgaagcttgtgcacactggagaactacctagggggtaatggcttgtaggtagggcgcaatataatttttcccccgcaggacaaaatggggtgtaagtagaggactgaattcttgttccactagatcttgggcttggttgaggcgatcgccgccataggcaatgaattgggcggtggaataggcgtaatattcttgtttggcagtttgattattttgtttgaaagcttggcgataaagctgggttgtctgctcgattaattgttcgatcgccggggtgaaagcaataattttgccactgggacaggcaatttttttaactttaataaaaccaattaccgtttgcatacattccctggtttgttccaccgataaacaatgttcgtcttggcgacggaaagcccactgcaaacagccattagagacttccagtacccgcaaaactgctaagttgtctaattcttcaggggcgatcgccgctaatccgggcaaatgttgttcaatttgttgctgaaagccagcaacatcttcggcaaaatagggctgtaactcagagattgcggccagggcctgccagttaacataggtcatcggaacatttgggacgaagattgggggcattctaacagaactgggagaaaacattgattaattgcaggcgttaaaatcgtcgccatggtaccctgtgacattcctcaacagcaattatagtaatttgtaaaacttatgagctattcatcaaaatacattttactaattagtgtccatggtttaattcggggagaaaaccttgagttgggcagagatgccgacaccggcgggcaaaccaaatatgtgctggaactgcggccgcagctcctgcctttgggcaggggcttttttgcatgcctgcaggacttcattgatccttgcctataccatcaatatcattggtcaataatgatgatgattgactaaaacatgtttaacaaaatttaacgcatatgctaaatgcgtaaactgcatatgccttggctgagtgtaatttacgttacaaattttaacgaaacgggaaccctatattgatctctactcatagattaatcctaatcttttgctatgaaatccccccaggctcaacaaatcctagaccaggcccgccgtttgctctacgaaaaagccatggtcaaaatcaatgggcaatacgtggggacggtggcggccattccccaatcggatcaccatgatttgaactatacggaagttttcattcgggacaatgtgccggtgatgatcttcttgttactgcaaaatgaaacggaaattgtccaaaactttttggaaatttgcctcaccctccaaagtaagggctttcccacctacggcatttttcccactagttttgtggaaacggaaaaccatgaactcaaggcagactatggccaacgggcgatcggtcgagtttgctcggtggatgcgtccctctggtggcctattttggcctattactacgtgcaaagaaccggcaatgaagcctgggctagacaaacccatgtgcaattggggctacaaaagtttttaaacctcattctccatccagtctttcgggatgcacccactttgtttgtgcccgacggggcctttatgattgaccgccccatggatgtgtggggagcgccgttggaaatccaaaccctgctctacggagccctgaaaagtgcggcggggttactgttaatcgacctcaaggcgaagggttattgcagcaataaagaccatccttttgacagcttcacgatggagcagagtcatcaatttaacctgagtgtggattggctcaaaaaactccgcacctatctgctcaagcattattggattaattgcaatattgtccaagctctccgccgccgtcccacggaacagtacggtgaagaagccagcaacgaacataatgtccacacagaaaccattcccaactggctccaggattggctcggcgatcggggaggctatttaatcggcaatatccgcacgggtcgccccgattttcgctttttctccctgggtaattgcttgggggcaattttcgatgtcactagcttggcccagcaacgttcctttttccgtttggtattaaataatcagcgggagttatgtgcccaaatgcccctgaggatttgccatccccccctcaaagatgacgattggcgcagtaaaaccggctttgaccgcaaaaatttaccctggtgctaccacaacgccggccattggccctgtttattttggtttctggtggtggcggtgctccgccatagctgccattccaactacggcacggtggagtatgcggaaatggggaacctaattcgcaataactatgaggtgcttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccgtttaaacagtaggtgaaagggtctgggagtaatctcagaccctttccctttttaattaagatccgtcgacctgcagttcgaagttcctattctctagaaagtataggaacttcagagcgcttttgaagctcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaataaggggatcttgaagttcctattccgaagttcctattctctagaaagtataggaacttcgaagcagctccagcctacacaatcgctcaagacgtgtaatgctgcacc

SEQ ID NO: 274 - DNA, 8713 bp, Artificial Sequence
  plasmid
ctagagaattccacctatgtccagctcatccatgcccccttggaaccctgcgaactggccttggacaatggacagtggtacgatcgccagaagatccgtcaccagttgcccgctagcaaaaccattgattgcctgttagtagatggaccgcccgcctaccgagaagacattcaatattcccggtttcctgcagtgccttttttccaaccgcaattggcaccccacagcaccatcattttggatgacattaaccgtaggggagaacaggaaattttagcccgttggcaaacattgctcaatgttagttttgatagctccattggcaatgtggcgatcgcccatctgtcggcctagggtaaattttaaaaatcccctgatccaccagtttcagggaaagccgggtaaaaatctgccagtgttgggatattggatattgagggaacgagctagaaccctactatctgtcagcctagcaaaccaaatgctttacatcgtcagactagttcaggaaaattaagtttgacccatagattaatcctaatcttttgctatgaaatccccccaggctcaacaaatcctagaccaggcccgccgtttgctctacgaaaaagccatgcggccgcagctcctgcctttgggcaggggcttttttgcatgcctgcaggaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgcaattttttcatcttgcgctgattactctactaaatatccgtcaagtaaattggctcttagctcgtctcctgtcaataaaggaggtcggcaagagtgcagaagcgggaatgtgtgaaaactaacccaattcattaaataccccgaaatataggggaatcatctcatactttccgtaaaccgcgaaggtcgtgaagggataaaagcaatttagtgggtgagaagaacagataaaaaagaattttttaactatggcaagaggaaaaagtaaaagcgttaacttatgcactcctagatgagcaagacactggtgaagaggattaccactaaagctaagtgttagttgcagaaaggtcgctgacctctaccaaaagattattcctgtttttctcctggctgatagggaggtagggcaattgtgagaggaaattgtaccaaaacgtgatttgataagtaaaaagagtgacatcttggaaggatccatatggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttctagccatcaccatcaccatcattaaatcgggccgcgtttaaacagtaggtgaaagggtctgggagtaatctcagaccctttccctttttaattaagatccgtcgacctgcagttcgaagttcctattctctagaaagtataggaacttcggcgcgcctacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttgtcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattacgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggcgtaaggcgcgccatttaaatgaagttcctattccgaagttcctattctctagaaagtataggaacttcgaagcagctccagcctacacaatcgctcaagacgtgtaatgctgcaccgcggtacccaggtgcttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccatttattttttgcccaattcctgggaacggcgataggccgcccgcactgcttcgatgatggcggaacgaaaacccatcttctccaataccgctaccccagcaatggtggtgccccccggactggtaactttatctttaatctgggcagggtgctcctccgtttccttgattaactccgctgtgcccaacactgtttgcaaagccaatttttgggcgatcgccctgggtaatccggccaaaacaccaccatcggccagggcttcgatcatcaaagctacgtaggccggtcccgaaccggaaacccccgtcaccgcatccattaaattttccggcacctccaccacattgcccaccgccgaaaagatggccttagccttagccaactgatccggctccaccattttattcgcggcgatcgccgtcataccggccccaacggtggcgggggtattgggcatggcccggatgatggcatggtcgggaaaacccttttgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctg

SEQ ID NO: 275 - DNA, 3434 bp, Artificial Sequence
  kanamycin resistance marker
ttgcatgcagattgcagcattacacgtcttgagcgattgtgtaggctggagctgcttcgaagttcctatactttctagagaataggaacttcggaataggaacttcaagatccccttattagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgagcttcaaaagcgctctgaagttcctatactttctagagaataggaacttcgaactgcaggtcgacggatccccggaattaattctcatgtttgacagcttatcactgatcagtgaattaatggcgatgacgcatcctcacgataatatccgggtaggcgcaatcactttcgtctctactccgttacaaagcgaggctgggtatttcccggcctttctgttatccgaaatccactgaaagcacagcggctggctgaggagataaataataaacgaggggctgtatgcacaaagcatcttctgttgagttaagaacgagtatcgagatggcacatagccttgctcaaattggaatcaggtttgtgccaataccagtagaaacagacgaagaagctagctttgcactggattgcgaggctttgccatggctaattcccatgtcagccgttaagtgttcctgtgtcactgaaaattgctttgagaggctctaagggcttctcagtgcgttacatccctggcttgttgtccacaaccgttaaaccttaaaagctttaaaagccttatatattcttttttttcttataaaacttaaaaccttagaggctatttaagttgctgatttatattaattttattgttcaaacatgagagcttagtacgtgaaacatgagagcttagtacgttagccatgagagcttagtacgttagccatgagggtttagttcgttaaacatgagagcttagtacgttaaacatgagagcttagtacgtgaaacatgagagcttagtacgtactatcaacaggttgaactgcggatcttgcggccgcaaaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgcatcgatggccccccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtggccagtgccaagc

SEQ ID NO: 276 - DNA, 34 bp, Artificial Sequence
  primer
gaattattaattaagatccgtcgacctgcagttc

SEQ ID NO: 277 - DNA, 33 bp, Artificial Sequence; identical to SEQ ID NO: 243
  primer

SEQ ID NO: 278 - DNA, 9003 bp, Artificial Sequence
  plasmid
gcggtacccaggtgcttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccatttattttttgcccaattcctgggaacggcgataggccgcccgcactgcttcgatgatggcggaacgaaaacccatcttctccaataccgctaccccagcaatggtggtgccccccggactggtaactttatctttaatctgggcagggtgctcctccgtttccttgattaactccgctgtgcccaacactgtttgcaaagccaatttttgggcgatcgccctgggtaatccggccaaaacaccaccatcggccagggcttcgatcatcaaagctacgtaggccggtcccgaaccggaaacccccgtcaccgcatccattaaattttccggcacctccaccacattgcccaccgccgaaaagatggccttagccttagccaactgatccggctccaccattttattcgcggcgatcgccgtcataccggccccaacggtggcgggggtattgggcatggcccggatgatggcatggtcgggaaaacccttttgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctgctagagaattccacctatgtccagctcatccatgcccccttggaaccctgcgaactggccttggacaatggacagtggtacgatcgccagaagatccgtcaccagttgcccgctagcaaaaccattgattgcctgttagtagatggaccgcccgcctaccgagaagacattcaatattcccggtttcctgcagtgccttttttccaaccgcaattggcaccccacagcaccatcattttggatgacattaaccgtaggggagaacaggaaattttagcccgttggcaaacattgctcaatgttagttttgatagctccattggcaatgtggcgatcgcccatctgtcggcctagggtaaattttaaaaatcccctgatccaccagtttcagggaaagccgggtaaaaatctgccagtgttgggatattggatattgagggaacgagctagaaccctactatctgtcagcctagcaaaccaaatgctttacatcgtcagactagttcaggaaaattaagtttgacccatagattaatcctaatcttttgctatgaaatccccccaggctcaacaaatcctagaccaggcccgccgtttgctctacgaaaaagccatgcggccgcagctcctgcctttgggcaggggcttttttgcatgcctgcaggaatgactattggcaactgacaactgactcctatacagtcattgatacattttgtaactgattgttaacaaaacgtttaaaactttatgtaataacaaatttaaatatgtaagttaagaactttcaaagaataacttatgccatttcttgatatattgtgagacaagttacaaattacgtggtgtgcaattttttcatcttgcgctgattactctactaaatatccgtcaagtaaattggctcttagctcgtctcctgtcaataaaggaggtcggcaagagtgcagaagcgggaatgtgtgaaaactaacccaattcattaaataccccgaaatataggggaatcatctcatactttccgtaaaccgcgaaggtcgtgaagggataaaagcaatttagtgggtgagaagaacagataaaaaagaattttttaactatggcaagaggaaaaagtaaaagcgttaacttatgcactcctagatgagcaagacactggtgaagaggattaccactaaagctaagtgttagttgcagaaaggtcgctgacctctaccaaaagattattcctgtttttctcctggctgatagggaggtagggcaattgtgagaggaaattgtaccaaaacgtgatttgataagtaaaaagagtgacatcttggaaggatccatatggcagctcaaaatctctacattctgcacattcagacccatggtctgctgcgagggcagaacttggaactggggcgagatgccgacaccggcgggcagaccaagtacgtcttagaactggctcaagcccaagctaaatccccacaagtccaacaagtcgacatcatcacccgccaaatcaccgacccccgcgtcagtgttggttacagtcaggcgatcgaaccctttgcgcccaaaggtcggattgtccgtttgccttttggccccaaacgctacctccgtaaagagctgctttggccccatctctacacctttgcggatgcaattctccaatatctggctcagcaaaagcgcaccccgacttggattcaggcccactatgctgatgctggccaagtgggatcactgctgagtcgctggttgaatgtaccgctaattttcacagggcattctctggggcggatcaagctaaaaaagctgttggagcaagactggccgcttgaggaaattgaagcgcaattcaatattcaacagcgaattgatgcggaggagatgacgctcactcatgctgactggattgtcgccagcactcagcaggaagtggaggagcaataccgcgtttacgatcgctacaacccagagcgcaagcttgtcattccaccgggtgtcgataccgatcgcttcaggtttcagcccttgggcgatcgcggtgttgttctccaacaggaactgagccgctttctgcgcgacccagaaaaacctcaaattctctgcctctgtcgccccgcacctcgcaaaaatgtaccggcgctggtgcgagcctttggcgaacatccttggctgcgcaaaaaagccaaccttgtcttagtactgggcagccgccaagacatcaaccagatggatcgcggcagtcggcaggtgttccaagagattttccatctggtcgatcgctacgacctctacggcagcgtcgcctatcccaaacagcatcaggctgatgatgtgccggagttctatcgcctagcggctcattccggcggggtattcgtcaatccggcgctgaccgaaccttttggtttgacaattttggaggcaggaagctgcggcgtgccggtggtggcaacccatgatggcggcccccaggaaattctcaaacactgtgatttcggcactttagttgatgtcagccgacccgctaatatcgcgactgcactcgccaccctgctgagcgatcgcgatctttggcagtgctatcaccgcaatggcattgaaaaagttcccgcccattacagctgggatcaacatgtcaataccctgtttgagcgcatggaaacggtggctttgcctcgtcgtcgtgctgtcagtttcgtacggagtcgcaaacgcttgattgatgccaaacgccttgtcgttagtgacatcgacaacacactgttgggcgatcgtcaaggactcgagaatttaatgacctatctcgatcagtatcgcgatcattttgcctttggaattgccacggggcgtcgcctagactctgcccaagaagtcttgaaagagtggggcgttccttcgccaaacttctgggtgacttccgtcggcagcgagattcactatggcaccgatgctgaaccggatatcagctgggaaaagcatatcaatcgcaactggaatcctcagcgaattcgggcagtaatggcacaactaccctttcttgaactgcagccggaagaggatcaaacacccttcaaagtcagcttctttgtccgcgatcgccacgagactgtgctgcgagaagtacggcaacatcttcgccgccatcgcctgcggctgaagtcaatctattcccatcaggagtttcttgacattctgccgctagctgcctcgaaaggggatgcgattcgccacctctcactccgctggcggattcctcttgagaacattttggtggcaggcgattctggtaacgatgaggaaatgctcaagggccataatctcggcgttgtagttggcaattactcaccggaattggagccactgcgcagctacgagcgcgtctattttgctgagggccactatgctaatggcattctggaagccttaaaacactatcgcttttttgaggcgatcgcttctagccatcaccatcaccatcattaaatcgggccgcgtttaaacagtaggtgaaagggtctgggagtaatctcagaccctttccctttttaattaagatccgtcgacctgcagttcgaagttcctattctctagaaagtataggaacttcagagcgcttttgaagctcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaataaggggatcttgaagttcctattccgaagttcctattctctagaaagtataggaacttcgaagcagctccagcctacacaatcgctcaagacgtgtaatgctgcacc

SEQ ID NO: 279 - DNA, 1863 bp, Artificial Sequence
  ntcA and ntcB
cctgcaggacttcattgatccttgcctataccatcaatatcattggtcaataatgatgatgattgactaaaacatgtttaacaaaatttaacgcatatgctaaatgcgtaaactgcatatgccttggctgagtgtaatttacgttacaaattttaacgaaacgggaaccctatattgatctctactcgcggagttataaggcacggttgcgatgctggccaacgaaaattctctgctgacgatgttccgggagttgggaagcggtaagctgcccctccagattgagcagtttgagcggggtaagaccatctttttcccgggggatccggctgaacgggtctacctgcttgtcaaaggagcggtcaagctctcacgagtctatgagtcgggcgaagaaattacggtggccctgctgcgtgagaacagcgtgtttggagtgctgtcgctgctgacaggtcagcgctccgatcgcttctaccatgcagtggcctttacgccggttcaactgttttcggtgccgatcgagttcatgcagaaggcgctgatcgaacggccggaactggccaacgtgatgctgcaggggctgtcctcgcggattctgcagaccgaaatgatgatcgagacgcttgcgcaccgcgatatgggttctcgcttggtcagctttttgctgattctctgtcgcgactttggcatccccagccctgatggcatcaccatcgatctcaagctttcccaccaggcaattgcggaagcgatcggctcaacgcgggtgacagtgacgcgcttgctgggtgacctacgggaatcaaaactgattgcgattcacaaaaagcggatcacggtctttaatccggtggcgctgagtcagcagttcagctaaatctcatgattaaggagtgggaagggtcgccatgcgcctagaacagctccaagccgcgctgcgggtggcggaaaccggaagttttcaagaagcagcccaaaaagtcggctgtaatcaatccacgatcagtcgccaagtcaagggattggaagatgagctagggattgccctgtttcggcgtcaggggcggatgaaactgacggcagcaggtgagcgtttactgccacggctgcgtcgcatttgccaagagtggcaaaccgcttgcactgaaattgaagagttgctgacggggcgtcaaaccgaattatgcatggcgatcgcagactcgatcggcggctgctatctgcccgctgtcctcaaccggtttcagcagcagtggccctccattcatttgcgcgtaagtacccttggcagcgatcgcgcgctgaaagtgctgcgggatggcttgattgatttggcgatcgtgatggactcgcccactttgaccactagtgccggtctcgtggtggatttgctgctcgaagaggaagtgcaggttctgctctccgttgatcatcctcttgctgaccaaaaggcgatcgcgtgggagcaactcagtcatgtcccccaagttgtctttaaggatggctacgggatgcagcgcttggtcgagcagcgctttcgagagttggggttagagctgaatagttgtctcgaactcaactcccttgacagctttcggggggtggtgcgagaaggctactggctggcgctgttaccgcaagccgccttggtcgatgcccgacatgatccgcgccttgtgattcgccctactgcagaaccgcgcctgactcgtcgcatcaagctggtcattcctgaggagcaactcagtctgccgccggtgcgccattttcgtcagctctgccgcgaagcgatgaccgctgaattatgtgattttaagacgttgagccaactgttctagctcggtgcgatcgcgtttaaac

SEQ ID NO: 280 - DNA, 1701 bp, Artificial Sequence
  invertase
cctgcaggacttcattgatccttgcctataccatcaatatcattggtcaataatgatgatgattgactaaaacatgtttaacaaaatttaacgcatatgctaaatgcgtaaactgcatatgccttggctgagtgtaatttacgttacaaattttaacgaaacgggaaccctatattgatctctactcatagattaatcctaatcttttgctatgaaatccccccaggctcaacaaatcctagaccaggcccgccgtttgctctacgaaaaagccatggtcaaaatcaatgggcaatacgtggggacggtggcggccattccccaatcggatcaccatgatttgaactatacggaagttttcattcgggacaatgtgccggtgatgatcttcttgttactgcaaaatgaaacggaaattgtccaaaactttttggaaatttgcctcaccctccaaagtaagggctttcccacctacggcatttttcccactagttttgtggaaacggaaaaccatgaactcaaggcagactatggccaacgggcgatcggtcgagtttgctcggtggatgcgtccctctggtggcctattttggcctattactacgtgcaaagaaccggcaatgaagcctgggctagacaaacccatgtgcaattggggctacaaaagtttttaaacctcattctccatccagtctttcgggatgcacccactttgtttgtgcccgacggggcctttatgattgaccgccccatggatgtgtggggagcgccgttggaaatccaaaccctgctctacggagccctgaaaagtgcggcggggttactgttaatcgacctcaaggcgaagggttattgcagcaataaagaccatccttttgacagcttcacgatggagcagagtcatcaatttaacctgagtgtggattggctcaaaaaactccgcacctatctgctcaagcattattggattaattgcaatattgtccaagctctccgccgccgtcccacggaacagtacggtgaagaagccagcaacgaacataatgtccacacagaaaccattcccaactggctccaggattggctcggcgatcggggaggctatttaatcggcaatatccgcacgggtcgccccgattttcgctttttctccctgggtaattgcttgggggcaattttcgatgtcactagcttggcccagcaacgttcctttttccgtttggtattaaataatcagcgggagttatgtgcccaaatgcccctgaggatttgccatccccccctcaaagatgacgattggcgcagtaaaaccggctttgaccgcaaaaatttaccctggtgctaccacaacgccggccattggccctgtttattttggtttctggtggtggcggtgctccgccatagctgccattccaactacggcacggtggagtatgcggaaatggggaacctaattcgcaataactatgaggtgcttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccgtttaaac

SEQ ID NO: 281 - DNA, 8019 bp, Artificial Sequence
  plasmid
aaacagtaggtgaaagggtctgggagtaatctcagaccctttccctttttaattaagatccgtcgacctgcagttcgaagttcctattctctagaaagtataggaacttcagagcgcttttgaagctcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaataaggggatcttgaagttcctattccgaagttcctattctctagaaagtataggaacttcgaagcagctccagcctacacaatcgctcaagacgtgtaatgctgcaccgcggtacccaggtgcttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccatttattttttgcccaattcctgggaacggcgataggccgcccgcactgcttcgatgatggcggaacgaaaacccatcttctccaataccgctaccccagcaatggtggtgccccccggactggtaactttatctttaatctgggcagggtgctcctccgtttccttgattaactccgctgtgcccaacactgtttgcaaagccaatttttgggcgatcgccctgggtaatccggccaaaacaccaccatcggccagggcttcgatcatcaaagctacgtaggccggtcccgaaccggaaacccccgtcaccgcatccattaaattttccggcacctccaccacattgcccaccgccgaaaagatggccttagccttagccaactgatccggctccaccattttattcgcggcgatcgccgtcataccggccccaacggtggcgggggtattgggcatggcccggatgatggcatggtcgggaaaacccttttgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctgctagagaattccacctatgtccagctcatccatgcccccttggaaccctgcgaactggccttggacaatggacagtggtacgatcgccagaagatccgtcaccagttgcccgctagcaaaaccattgattgcctgttagtagatggaccgcccgcctaccgagaagacattcaatattcccggtttcctgcagtgccttttttccaaccgcaattggcaccccacagcaccatcattttggatgacattaaccgtaggggagaacaggaaattttagcccgttggcaaacattgctcaatgttagttttgatagctccattggcaatgtggcgatcgcccatctgtcggcctagggtaaattttaaaaatcccctgatccaccagtttcagggaaagccgggtaaaaatctgccagtgttgggatattggatattgagggaacgagctagaaccctactatctgtcagcctagcaaaccaaatgctttacatcgtcagactagttcaggaaaattaagtttgacccatagattaatcctaatcttttgctatgaaatccccccaggctcaacaaatcctagaccaggcccgccgtttgctctacgaaaaagccatgcggccgcagctcctgcctttgggcaggggcttttttgcatgcctgcaggacttcattgatccttgcctataccatcaatatcattggtcaataatgatgatgattgactaaaacatgtttaacaaaatttaacgcatatgctaaatgcgtaaactgcatatgccttggctgagtgtaatttacgttacaaattttaacgaaacgggaaccctatattgatctctactcgcggagttataaggcacggttgcgatgctggccaacgaaaattctctgctgacgatgttccgggagttgggaagcggtaagctgcccctccagattgagcagtttgagcggggtaagaccatctttttcccgggggatccggctgaacgggtctacctgcttgtcaaaggagcggtcaagctctcacgagtctatgagtcgggcgaagaaattacggtggccctgctgcgtgagaacagcgtgtttggagtgctgtcgctgctgacaggtcagcgctccgatcgcttctaccatgcagtggcctttacgccggttcaactgttttcggtgccgatcgagttcatgcagaaggcgctgatcgaacggccggaactggccaacgtgatgctgcaggggctgtcctcgcggattctgcagaccgaaatgatgatcgagacgcttgcgcaccgcgatatgggttctcgcttggtcagctttttgctgattctctgtcgcgactttggcatccccagccctgatggcatcaccatcgatctcaagctttcccaccaggcaattgcggaagcgatcggctcaacgcgggtgacagtgacgcgcttgctgggtgacctacgggaatcaaaactgattgcgattcacaaaaagcggatcacggtctttaatccggtggcgctgagtcagcagttcagctaaatctcatgattaaggagtgggaagggtcgccatgcgcctagaacagctccaagccgcgctgcgggtggcggaaaccggaagttttcaagaagcagcccaaaaagtcggctgtaatcaatccacgatcagtcgccaagtcaagggattggaagatgagctagggattgccctgtttcggcgtcaggggcggatgaaactgacggcagcaggtgagcgtttactgccacggctgcgtcgcatttgccaagagtggcaaaccgcttgcactgaaattgaagagttgctgacggggcgtcaaaccgaattatgcatggcgatcgcagactcgatcggcggctgctatctgcccgctgtcctcaaccggtttcagcagcagtggccctccattcatttgcgcgtaagtacccttggcagcgatcgcgcgctgaaagtgctgcgggatggcttgattgatttggcgatcgtgatggactcgcccactttgaccactagtgccggtctcgtggtggatttgctgctcgaagaggaagtgcaggttctgctctccgttgatcatcctcttgctgaccaaaaggcgatcgcgtgggagcaactcagtcatgtcccccaagttgtctttaaggatggctacgggatgcagcgcttggtcgagcagcgctttcgagagttggggttagagctgaatagttgtctcgaactcaactcccttgacagctttcggggggtggtgcgagaaggctactggctggcgctgttaccgcaagccgccttggtcgatgcccgacatgatccgcgccttgtgattcgccctactgcagaaccgcgcctgactcgtcgcatcaagctggtcattcctgaggagcaactcagtctgccgccggtgcgccattttcgtcagctctgccgcgaagcgatgaccgctgaattatgtgattttaagacgttgagccaactgttctagctcggtgcgatcgcgttt

SEQ ID NO: 282 - DNA, 7857 bp, Artificial Sequence
  plasmid
aaacagtaggtgaaagggtctgggagtaatctcagaccctttccctttttaattaagatccgtcgacctgcagttcgaagttcctattctctagaaagtataggaacttcagagcgcttttgaagctcacgctgccgcaagcactcagggcgcaagggctgctaaaggaagcggaacacgtagaaagccagtccgcagaaacggtgctgaccccggatgaatgtcagctactgggctatctggacaagggaaaacgcaagcgcaaagagaaagcaggtagcttgcagtgggcttacatggcgatagctagactgggcggttttatggacagcaagcgaaccggaattgccagctggggcgccctctggtaaggttgggaagccctgcaaagtaaactggatggctttcttgccgccaaggatctgatggcgcaggggatcaagatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctaataaggggatcttgaagttcctattccgaagttcctattctctagaaagtataggaacttcgaagcagctccagcctacacaatcgctcaagacgtgtaatgctgcaccgcggtacccaggtgcttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccatttattttttgcccaattcctgggaacggcgataggccgcccgcactgcttcgatgatggcggaacgaaaacccatcttctccaataccgctaccccagcaatggtggtgccccccggactggtaactttatctttaatctgggcagggtgctcctccgtttccttgattaactccgctgtgcccaacactgtttgcaaagccaatttttgggcgatcgccctgggtaatccggccaaaacaccaccatcggccagggcttcgatcatcaaagctacgtaggccggtcccgaaccggaaacccccgtcaccgcatccattaaattttccggcacctccaccacattgcccaccgccgaaaagatggccttagccttagccaactgatccggctccaccattttattcgcggcgatcgccgtcataccggccccaacggtggcgggggtattgggcatggcccggatgatggcatggtcgggaaaacccttttgaattcaagcttcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccgcagacccgccataaaacgccctgagaagcccgtgacgggcttttcttgtattatgggtagtttccttgcatgaatccataaaaggcgcctgtagtgccatttacccccattcactgccagagccgtgagcgcagcgaactgaatgtcacgaaaaagacagcgactcaggtgcctgatggtcggagacaaaaggaatattcagcgatttgcccgagcttgcgagggtgctacttaagcctttagggttttaaggtctgttttgtagaggagcaaacagcgtttgcgacatccttttgtaatactgcggaactgactaaagtagtgagttatacacagggctgggatctattctttttatctttttttattctttctttattctataaattataaccacttgaatataaacaaaaaaaacacacaaaggtctagcggaatttacagagggtctagcagaatttacaagttttccagcaaaggtctagcagaatttacagatacccacaactcaaaggaaaaggactagtaattatcattgactagcccatctcaattggtatagtgattaaaatcacctagaccaattgagatgtatgtctgaattagttgttttcaaagcaaatgaactagcgattagtcgctatgacttaacggagcatgaaaccaagctaattttatgctgtgtggcactactcaaccccacgattgaaaaccctacaaggaaagaacggacggtatcgttcacttataaccaatacgctcagatgatgaacatcagtagggaaaatgcttatggtgtattagctaaagcaaccagagagctgatgacgagaactgtggaaatcaggaatcctttggttaaaggctttgagattttccagtggacaaactatgccaagttctcaagcgaaaaattagaattagtttttagtgaagagatattgccttatcttttccagttaaaaaaattcataaaatataatctggaacatgttaagtcttttgaaaacaaatactctatgaggatttatgagtggttattaaaagaactaacacaaaagaaaactcacaaggcaaatatagagattagccttgatgaatttaagttcatgttaatgcttgaaaataactaccatgagtttaaaaggcttaaccaatgggttttgaaaccaataagtaaagatttaaacacttacagcaatatgaaattggtggttgataagcgaggccgcccgactgatacgttgattttccaagttgaactagatagacaaatggatctcgtaaccgaacttgagaacaaccagataaaaatgaatggtgacaaaataccaacaaccattacatcagattcctacctacataacggactaagaaaaacactacacgatgctttaactgcaaaaattcagctcaccagttttgaggcaaaatttttgagtgacatgcaaagtaagtatgatctcaatggttcgttctcatggctcacgcaaaaacaacgaaccacactagagaacatactggctaaatacggaaggatctgaggttcttatggctcttgtatctatcagtgaagcatcaagactaacaaacaaaagtagaacaactgttcaccgttacatatcaaagggaaaactgtccatatgcacagatgaaaacggtgtaaaaaagatagatacatcagagcttttacgagtttttggtgcattcaaagctgttcaccatgaacagatcgacaatgtaacagatgaacagcatgtaacacctaatagaacaggtgaaaccagtaaaacaaagcaactagaacatgaaattgaacacctgagacaacttgttacagctcaacagtcacacatagacagcctgaaacaggcgatgctgcttatcgaatcaaagctgccgacaacacgggagccagtgacgcctcccgtggggaaaaaatcatggcaattctggaagaaatagcgctttcagccggcaaaccggctgaagccggatctgcgattctgataacaaactagcaacaccagaacagcccgtttgcgggcagcaaaacccgtacttttggacgttccggcggttttttgtggcgagtggtgttcgggcggtgcgcgcaagatccattatgttaaacgggcgagtttacatctcaaaaccgcccgcttaacaccatcagaaatcctcagcgcgattttaagcaccaacccccccccgtaacacccaaatccatactgaaagtggctttgttgaataaatcagatttcgggtaagtctcccccgtagcgggttgtgttttcaggcaatacgcacgctttcaggcatacctgctttcgtcattttgttcagcgctcgtaccagggccatagcctccgcaacctgaccatcgtagtcacgcagcgtcagtgaacccccgaacagctgtaatccgggcagcgcaacggaacattcatcagtgtaaaaatggaatcaataaagccctgcgcagcgcgcagggtcagcctgaatacgcgtattcaggctgaccctgcgcgctgcgcagggctttattgattccatttttacactgatgaatgttccgttgcgctgcccggattacagctgtgtcagcaggcgggcaaagtcggctgcatcgcgtccgtctatgcgttttgtgcagcccagaacggaatctcagcaggcaatgcgggctctgcatcgtgtccgtgaatccctggttcaggataaggtaaaaacaaccaatcaaatgatcgtccattccgacagcatcgccagtcactatggcgtgctgctagagaattccacctatgtccagctcatccatgcccccttggaaccctgcgaactggccttggacaatggacagtggtacgatcgccagaagatccgtcaccagttgcccgctagcaaaaccattgattgcctgttagtagatggaccgcccgcctaccgagaagacattcaatattcccggtttcctgcagtgccttttttccaaccgcaattggcaccccacagcaccatcattttggatgacattaaccgtaggggagaacaggaaattttagcccgttggcaaacattgctcaatgttagttttgatagctccattggcaatgtggcgatcgcccatctgtcggcctagggtaaattttaaaaatcccctgatccaccagtttcagggaaagccgggtaaaaatctgccagtgttgggatattggatattgagggaacgagctagaaccctactatctgtcagcctagcaaaccaaatgctttacatcgtcagactagttcaggaaaattaagtttgacccatagattaatcctaatcttttgctatgaaatccccccaggctcaacaaatcctagaccaggcccgccgtttgctctacgaaaaagccatgcggccgcagctcctgcctttgggcaggggcttttttgcatgcctgcaggacttcattgatccttgcctataccatcaatatcattggtcaataatgatgatgattgactaaaacatgtttaacaaaatttaacgcatatgctaaatgcgtaaactgcatatgccttggctgagtgtaatttacgttacaaattttaacgaaacgggaaccctatattgatctctactcatagattaatcctaatcttttgctatgaaatccccccaggctcaacaaatcctagaccaggcccgccgtttgctctacgaaaaagccatggtcaaaatcaatgggcaatacgtggggacggtggcggccattccccaatcggatcaccatgatttgaactatacggaagttttcattcgggacaatgtgccggtgatgatcttcttgttactgcaaaatgaaacggaaattgtccaaaactttttggaaatttgcctcaccctccaaagtaagggctttcccacctacggcatttttcccactagttttgtggaaacggaaaaccatgaactcaaggcagactatggccaacgggcgatcggtcgagtttgctcggtggatgcgtccctctggtggcctattttggcctattactacgtgcaaagaaccggcaatgaagcctgggctagacaaacccatgtgcaattggggctacaaaagtttttaaacctcattctccatccagtctttcgggatgcacccactttgtttgtgcccgacggggcctttatgattgaccgccccatggatgtgtggggagcgccgttggaaatccaaaccctgctctacggagccctgaaaagtgcggcggggttactgttaatcgacctcaaggcgaagggttattgcagcaataaagaccatccttttgacagcttcacgatggagcagagtcatcaatttaacctgagtgtggattggctcaaaaaactccgcacctatctgctcaagcattattggattaattgcaatattgtccaagctctccgccgccgtcccacggaacagtacggtgaagaagccagcaacgaacataatgtccacacagaaaccattcccaactggctccaggattggctcggcgatcggggaggctatttaatcggcaatatccgcacgggtcgccccgattttcgctttttctccctgggtaattgcttgggggcaattttcgatgtcactagcttggcccagcaacgttcctttttccgtttggtattaaataatcagcgggagttatgtgcccaaatgcccctgaggatttgccatccccccctcaaagatgacgattggcgcagtaaaaccggctttgaccgcaaaaatttaccctggtgctaccacaacgccggccattggccctgtttattttggtttctggtggtggcggtgctccgccatagctgccattccaactacggcacggtggagtatgcggaaatggggaacctaattcgcaataactatgaggtgcttttgcgccgtttgcccaagcataaatgggctgaatattttgatggccccacgggcttttgggtcgggcaacaatcccgttcctaccaaacctggaccattgtgggcctattgctagtacaccatttcacagaagttaaccccgacgatgctttgatgttcgatttgcctagtttgaaaagtttgcatcaagcgctgcattaaattccgttgtccgttt

SEQ ID NO: 283 - DNA, 24 bp, Artificial Sequence
  primer
gtgaattgttaccgacggtgagac

SEQ ID NO: 284 - DNA, 24 bp, Artificial Sequence
  primer
tacgccaccaatgaccgtacctaa

SEQ ID NO: 285 - DNA, 20 bp, Artificial Sequence
  primer
cgatcttctgctgtgaattg

SEQ ID NO: 286 - DNA, 22 bp, Artificial Sequence
  primer
gcttaactccgtaaccattgtc

What is claimed is:

1. A nitrogen-sensitive expression system comprising:
a nucleic acid sequence comprising an upstream truncated or downstream truncated variant of SEQ ID NO: 234 or a sequence having at least 95% sequence identity to said truncated sequence;
wherein the upstream truncated or downstream truncated variant of SEQ ID NO: 234 or the sequence having at least 95% sequence identity thereto comprises (i) a transcription factor region comprising an NtcA binding site, (ii) a core promoter region, and (iii) nitrogen-sensitive promoter activity;
wherein,
the upstream truncated variant of SEQ ID NO: 234 does not contain
(a) nucleotide positions 1 to 78 of SEQ ID NO: 234,
(b) nucleotide positions 1 to 128 of SEQ ID NO: 234,
(c) nucleotide positions 1 to 138 of SEQ ID NO: 234,
(d) nucleotide positions 1 to 148 of SEQ ID NO: 234,
(e) nucleotide positions 1 to 158 of SEQ ID NO: 234,
(f) nucleotide positions 1 to 166 of SEQ ID NO: 234,
(g) nucleotide positions 1 to 168 of SEQ ID NO: 234,
(h) nucleotide positions 1 to 178 of SEQ ID NO: 234,
(i) nucleotide positions 1 to 188 of SEQ ID NO: 234,
(j) nucleotide positions 1 to 198 of SEQ ID NO: 234,
(k) nucleotide positions 1 to 208 of SEQ ID NO: 234,
(l) nucleotide positions 1 to 218 of SEQ ID NO: 234,
(m) nucleotide positions 1 to 228 of SEQ ID NO: 234, or
(n) nucleotide positions 1 to 238 of SEQ ID NO: 234; or
the downstream truncated variant of SEQ ID NO: 234 does not contain
(a) nucleotide positions 347 to 836 of SEQ ID NO: 234,
(b) nucleotide positions 353 to 836 of SEQ ID NO: 234,
(c) nucleotide positions 357 to 836 of SEQ ID NO: 234,
(d) nucleotide positions 367 to 836 of SEQ ID NO: 234,
(e) nucleotide positions 377 to 836 of SEQ ID NO: 234,
(f) nucleotide positions 387 to 836 of SEQ ID NO: 234,
(g) nucleotide positions 397 to 836 of SEQ ID NO: 234,
(h) nucleotide positions 407 to 836 of SEQ ID NO: 234,
(i) nucleotide positions 417 to 836 of SEQ ID NO: 234,
(j) nucleotide positions 427 to 836 of SEQ ID NO: 234,
(k) nucleotide positions 477 to 836 of SEQ ID NO: 234,
(l) nucleotide positions 527 to 836 of SEQ ID NO: 234,
(m) nucleotide positions 577 to 836 of SEQ ID NO: 234,
(n) nucleotide positions 627 to 836 of SEQ ID NO: 234,
(o) nucleotide positions 677 to 836 of SEQ ID NO: 234,
(p) nucleotide positions 727 to 836 of SEQ ID NO: 234,
(q) nucleotide positions 777 to 836 of SEQ ID NO: 234,
(r) nucleotide positions 807 to 836 of SEQ ID NO: 234, or
(s) nucleotide positions 817 to 836 of SEQ ID NO: 234,
wherein,
the core promoter region comprises or is operably linked to the transcription factor region; and
the nitrogen-sensitive promoter activity comprises promoter activity when urea or ammonia is the predominant nitrogen source and promoter repression when nitrate is a predominant nitrogen source;
the nitrogen-sensitive expression system further comprises a transcribable nucleic acid molecule and a 3' transcription termination nucleic acid molecule;
the core promoter region is operably linked to the transcribable nucleic acid molecule;
the transcribable nucleic acid molecule is operably linked to the 3' transcription termination nucleic acid molecule;
expression of the transcribable nucleic acid molecule is repressed when nitrate is a predominant nitrogen source and the transcribable nucleic acid molecule is expressed when urea or ammonia is the predominant nitrogen source; and
the transcribable nucleic acid molecule encodes a polypeptide having sucrose phosphate synthase activity; sucrose phosphate phosphatase activity, sucrose phosphate synthase and sucrose phosphate phosphatase activity; trehalose phosphate synthase activity; trehalose phosphate phosphatase activity, gluocosylglycerol phosphate synthase activity; gluocosylglycerol phosphate phosphatase activity; mannosylfructose phosphate synthase activity; or mannosylfructose phosphate phosphatase activity.

2. The expression system of claim 1, wherein the transcription factor region comprises at least one of: a GTAN$_{11}$C consensus sequence; a GTAN$_8$TAC consensus sequence; a GTAN$_8$TGC consensus sequence; a GTN$_{10}$AC consensus sequence; a TGTN$_9$ACA consensus sequence; or a TGTN$_{10}$ACA consensus sequence.

3. The expression system of claim 1, wherein the transcription factor region comprises at least one of a TAN$_3$T/A box.

4. The expression system of claim 1, wherein the nitrogen-sensitive expression system comprises SEQ ID NO: 189 or SEQ ID NO: 190.

5. The expression system of claim 1, wherein the transcribable nucleic acid molecule comprises:
   SEQ ID NO: 1, or at least 95% sequence identity thereto and encoding a polypeptide having sucrose phosphate synthase and sucrose phosphate phosphatase activity; or
   a nucleic acid sequence encoding a polypeptide of SEQ ID NO: 2, or a polypeptide at least 95% similar thereto having sucrose phosphate synthase and sucrose phosphate phosphatase activity.

6. An expression cassette comprising:
   (a) the expression system of claim 1;
   (b) a transcribable nucleic acid molecule;
   (c) a 3' transcription termination nucleic acid molecule; and
   (d) a nitrate inducible promoter operably linked to a polynucleotide sequence encoding an NtcA polypeptide or an NtcB polypeptide;
   wherein,
   the core promoter region is operably linked to the transcribable nucleic acid molecule;
   the transcribable nucleic acid molecule is operably linked to the 3' transcription termination nucleic acid molecule;
   elements (a)-(c) are positioned in relation to each other such that expression of the expression cassette in a host organism results in production of a polypeptide sequence encoded by the transcribable nucleic acid molecule; and
   element (d) is positioned such that expression of the expression cassette in the host organism results in production of the NtcA polypeptide or the NtcB polypeptide.

7. A transgenic host cell:
   comprising the expression system of claim 1; or
   the expression cassette of claim 6;
   wherein
   expression of the polypeptide sequence encoded by the transcribable nucleic acid molecule is repressed in the presence of nitrate; and
   expression of the polypeptide sequence encoded by the transcribable nucleic acid molecule is induced in the presence of urea or ammonia.

8. A kit comprising the expression system of claim 1 or the expression cassette of claim 6 and at least one reagent for introducing the expression cassette into a host cell and, optionally, instructions for introducing the expression cassette into a host cell.

9. The nitrogen-sensitive expression system of claim 1, wherein the upstream truncated variant of SEQ ID NO: 234 does not contain nucleotide positions 1 to 166 of SEQ ID NO: 234.

10. The nitrogen-sensitive expression system of claim 1, wherein the downstream truncated variant of SEQ ID NO: 234 does not contain nucleotide positions 353 to 836 of SEQ ID NO: 234.

11. The expression cassette of claim 6, wherein:
    the nitrate inducible promoter comprises a nirA promoter having SEQ ID NO: 32; and
    polynucleotide sequence encoding an NtcA polypeptide has a sequence of SEQ ID NO: 279.

\* \* \* \* \*